US010392425B2

(12) United States Patent
Poma et al.

(10) Patent No.: US 10,392,425 B2
(45) Date of Patent: Aug. 27, 2019

(54) MULTIVALENT CD20-BINDING MOLECULES COMPRISING SHIGA TOXIN A SUBUNIT EFFECTOR REGIONS AND ENRICHED COMPOSITIONS THEREOF

(71) Applicant: Molecular Templates, Inc., Austin, TX (US)

(72) Inventors: Eric Poma, New York, NY (US); Erin Willert, Round Rock, TX (US); Jason Kim, Austin, TX (US); Jack Higgins, Georgetown, TX (US); Jensing Liu, Round Rock, TX (US); Rodney Flores-Lefranc, Round Rock, TX (US)

(73) Assignee: Molecular Templates, Inc., Austin, TX (US)

( * ) Notice: Subject to any disclaimer, the term of this patent is extended or adjusted under 35 U.S.C. 154(b) by 0 days.

(21) Appl. No.: 15/549,099

(22) PCT Filed: Feb. 4, 2016

(86) PCT No.: PCT/US2016/016580
§ 371 (c)(1),
(2) Date: Aug. 4, 2017

(87) PCT Pub. No.: WO2016/126950
PCT Pub. Date: Aug. 11, 2016

(65) Prior Publication Data
US 2018/0057544 A1    Mar. 1, 2018

Related U.S. Application Data

(60) Provisional application No. 62/112,314, filed on Feb. 5, 2015, provisional application No. 62/249,193, filed on Oct. 31, 2015.

(51) Int. Cl.
*C07K 16/28*    (2006.01)
*C07K 14/25*    (2006.01)

(52) U.S. Cl.
CPC .......... *C07K 14/25* (2013.01); *C07K 16/2887* (2013.01); *C07K 2317/35* (2013.01); *C07K 2317/622* (2013.01); *C07K 2319/55* (2013.01)

(58) Field of Classification Search
CPC ............... C07K 14/25; C07K 16/2887; C07K 2317/35; C07K 2317/622; C07K 2319/55
See application file for complete search history.

(56) References Cited

U.S. PATENT DOCUMENTS

| | | | |
|---|---|---|---|
| 5,635,384 A | 6/1997 | Walsh | |
| 5,668,255 A | 9/1997 | Murphy | |
| 6,022,950 A | 2/2000 | Murphy | |
| 6,492,498 B1 | 12/2002 | Vallera | |
| 7,267,973 B2 | 9/2007 | Backer | |
| 7,527,787 B2 | 5/2009 | Chang | |
| 7,700,557 B2 | 4/2010 | Backer | |
| 7,713,915 B1* | 5/2010 | Gariepy | ............. C12N 15/1055 506/2 |
| 7,834,258 B2 | 11/2010 | Choe | |
| 8,147,832 B2* | 4/2012 | Carr | ................... C07K 16/2887 424/133.1 |
| 8,895,006 B2 | 11/2014 | Tumer | |
| 8,969,529 B2 | 3/2015 | O'Brien | |
| 9,175,059 B2 | 11/2015 | Pieczykolan | |
| 9,364,557 B2 | 6/2016 | Neville | |
| 2002/0168370 A1 | 11/2002 | McDonald | |
| 2004/0166565 A1 | 8/2004 | Backer | |
| 2005/0069545 A1* | 3/2005 | Carr | ................... C07K 16/2887 424/144.1 |
| 2009/0023649 A1 | 1/2009 | Backer | |

(Continued)

FOREIGN PATENT DOCUMENTS

| | | |
|---|---|---|
| JP | 2001500730 | 1/2001 |
| JP | 2002544173 | 12/2002 |

(Continued)

OTHER PUBLICATIONS

Wu et al., J. Mol. Biol. 294: 151-162 (Year: 1999).*
Wargalla et al., Proc Natl. Acad. Sci. USA 86: 5146-5150 (Year: 1989).*
Jubala et al., Vet Pathol 42: 468-476 (Year: 2005).*
Bera et al., J Mol Biol 281: 475-483 (Year: 1998).*
Cuesta et al., Trends in Biotechnology 28: 355-362 (Year: 2010).*
Casalini, P., et al., "Use of Combination of Monoclonal Antibodies Directed Against Three Distinct Epitopes of a Tumor-Associated Antigen: Analysis of Cell Binding and Internalization", International Journal of Cancer 48 (2), (1991), 284-290.

(Continued)

*Primary Examiner* — Phuong Huynh
(74) *Attorney, Agent, or Firm* — Nixon Peabody LLP; Mark J. FitzGerald; Teresa A. Ptashka

(57) ABSTRACT

The present invention provides multivalent CD20-binding molecules, and compositions thereof, such as enriched compositions comprising large proportions of multivalent CD20-binding molecule relative to monovalent CD20-binding molecule. Certain multivalent CD20-binding molecules of the present invention comprise 1) two or more CD20 binding regions and 2) one or more Shiga toxin effector polypeptide regions derived from an A Subunit of a member of the Shiga toxin family. Certain multivalent CD20-binding molecules of the present invention, and compositions thereof, have uses for selective killing specific cell types and as therapeutics for the treatment of a variety of diseases, including cancers, tumors, and immune disorders. Certain multivalent CD20-binding molecules of the present invention, and compositions thereof, have uses for delivering agents into CD20-expressing cells, including for the intracellular labeling of CD20-expressing cells, collecting diagnostic information, and monitoring the treatment of variety diseases, such as cancers, tumors, and immune disorders which involve CD20-expressing cells.

24 Claims, 13 Drawing Sheets
Specification includes a Sequence Listing.

(56) References Cited

U.S. PATENT DOCUMENTS

| | | |
|---|---|---|
| 2012/0251542 A1 | 10/2012 | Tumer |
| 2013/0196928 A1 | 8/2013 | Gariepy |
| 2015/0259428 A1 | 9/2015 | Poma et al. |
| 2016/0017047 A1 | 1/2016 | Poma et al. |
| 2016/0068577 A1 | 3/2016 | Poma et al. |
| 2016/0177284 A1 | 6/2016 | Poma et al. |
| 2016/0340394 A1 | 11/2016 | Poma et al. |
| 2016/0347798 A1 | 12/2016 | Poma et al. |
| 2016/0355803 A1 | 12/2016 | Poma et al. |
| 2016/0376328 A1 | 12/2016 | Poma et al. |
| 2017/0002046 A1 | 1/2017 | Poma et al. |
| 2017/0143814 A1 | 5/2017 | Poma et al. |

FOREIGN PATENT DOCUMENTS

| | | | | |
|---|---|---|---|---|
| JP | 2003531588 | 10/2003 | | |
| JP | 2008533977 | 8/2008 | | |
| JP | 2009502936 | 1/2009 | | |
| JP | 2012044997 | 3/2012 | | |
| JP | 2012070737 | 4/2012 | | |
| KR | 2011-0033233 | 4/2001 | | |
| KR | 2011-0119725 | 11/2011 | | |
| WO | WO-1998011229 | 3/1998 | | |
| WO | WO-2000067795 | 11/2000 | | |
| WO | WO-2001077342 | 10/2001 | | |
| WO | WO 03/066854 | 8/2003 | | |
| WO | WO-2004056312 | 7/2004 | | |
| WO | WO-2005000902 | 1/2005 | | |
| WO | WO-2005016969 | 2/2005 | | |
| WO | WO-2005092917 | 10/2005 | | |
| WO | WO-2006099875 | 9/2006 | | |
| WO | WO-2007014238 | 2/2007 | | |
| WO | WO-2007033497 | 3/2007 | | |
| WO | WO-2008080218 | 7/2008 | | |
| WO | WO-2009017823 | 2/2009 | | |
| WO | WO 2007098201 | 4/2009 | | |
| WO | WO-2009064815 | 5/2009 | | |
| WO | WO-2009088403 | 7/2009 | | |
| WO | WO-2009110944 | 9/2009 | | |
| WO | WO-2009032954 | 12/2009 | | |
| WO | WO-2010011697 | 1/2010 | | |
| WO | WO-2010085539 | 7/2010 | | |
| WO | WO-2011009624 | 1/2011 | | |
| WO | WO-2012022985 | 2/2012 | | |
| WO | WO-2012104344 | 8/2012 | | |
| WO | WO-2012154530 | 11/2012 | | |
| WO | WO-2013080147 | 6/2013 | | |
| WO | WO-2014164680 | 10/2014 | | |
| WO | WO-2014164680 A1 * | 10/2014 | ........... | C07K 16/085 |
| WO | WO-2014164693 | 10/2014 | | |
| WO | WO-2015063187 | 10/2014 | | |
| WO | WO-2015113005 | 7/2015 | | |
| WO | WO-2015113007 | 7/2015 | | |
| WO | WO-2015138435 | 9/2015 | | |
| WO | WO-2015138452 | 9/2015 | | |
| WO | WO-2015191764 | 12/2015 | | |
| WO | WO-2016196344 | 12/2016 | | |
| WO | WO-2017019623 | 2/2017 | | |

OTHER PUBLICATIONS

Beers, SA, et al., "CD20 as a Target for Therapeutic Type I and II Monoclonal Antibodies", Seminars in Hematology, 47(2), (2010), 107-114.

U.S. Appl. No. 15/290,299, filed Oct. 11, 2015, Molecular Templates, Inc.

Al-Jaufy, AY, et al., "Cytotoxicity of a Shiga Toxin A Subunit-CD4 Fusion Protein to Human Immunodeficiency Virus-Infected Cells", Infection and Immunity, 62(3), (1994), 956-960.

Al-Jaufy, AY, et al., "Purification and Characterization of a Shiga Toxin A Subunit-CD4 Fusion Protein Cytotoxic to Human Immunodeficiency Virus-Infected Cells", Infection and Immunity, 63(8), (1995), 3073-3078.

Beers, SA, et al., "Type II (tositumomab) anti-CD20 monoclonal antibody out performs type I (rituximab-like) reagents in B-cell depletion regardless of complement activation", Blood, 112, (2008), 4170-4177.

Beers, SA, et al., "Antigenic modulation limits the efficacy of anti-CD20 antibodies: implications for antibody selection", Blood, 115(25), (2010), 5191-5201.

Bera, TK, et al., "A Bivalent Disulfide-stabilized Fv with Improved Antigen Binding to erbB2", Journal of Molecular Biology 281(3), (1998), 475-483.

Bera, TK, et al., "Pharmacokinetics and Antitumor Activity of a Bivalent Disulfide-stabilized Fv Immunotoxin with Improved Antigen Binding to erbB2", Cancer Research, 59(16), (1999), 4018-4022.

Beum, PV, et al., "The Shaving Reaction: Rituximab/CD20 Complexes Are Removed from Mantle Cell Lymphoma and Chronic Lymphocytic Leukemia Cells by THP-1 Monocytes", Journal of Immunology, 176(4), (2006), 2600-2609.

Beum, PV, et al., "Loss of CD20 and Bound CD20 Antibody from Opsonized B Cells Occurs More Rapidly Because of Trogocytosis Mediated by Fc Receptor-Expressing Effector Cells Than Direct Internalization by the B Cells", Journal of Immunology, 187(6), (2011), 3438-3447.

Boross, P, et al., "Both activating and inhibitory Fc gamma receptors mediate rituximab-induced trogocytosis of CD20 in mice", Immunology Letters, 143(1), (2012), 44-52.

Boross, P, et al., "Mechanisms of action of CD20 antibodies", American Journal of Cancer Research, 2(6), (2012), 676-690.

Braslawsky, GR, et al., "Adriamycin(hydrazone)-antibody conjugates require internalization and intracellular acid hydrolysis for antitumor activity", Cancer Immunology, Immunotherapy 33, (1991), 367-374.

Bray, MR, et al., "Probing the surface of eukaryotic cells using combinatorial toxin libraries", Current Biology, 11(9), (2001), 697-701.

Brigotti, M, et al., "Change in Conformation with Reduction of α-Helix Content Causes Loss of Neutrophil Binding Activity in Fully Cytotoxic Shiga Toxin 1", The Journal of Biological Chemistry, 286(40), (2011), 34514-34521.

Burgess, BJ, et al., "Proteolytic cleavage at arginine residues within the hydrophilic disulphide loop of the *Escherichia coli* Shiga-like toxin I A subunit is not essential for cytotoxicity", Molecular Microbiology, 10(1), (1993), 171-179.

Cao, C, et al., "Construction of mutant genes for a non-toxic verotoxin 2 variant (VT2vp1) of *Escherichia coli* and characterization of purified mutant toxins", Microbiology and Immunology, 38(6), (1994), 441-447.

Cheung, MC, et al., "An evolved ribosome-inactivating protein targets and kills human melanoma cells in vitro and in vivo", Molecular Cancer, 9(28), (2010).

Cheung, MC, et al., "A Ribosome-inactivating Protein Toxin as a Template for Cancer Drug Discovery", thesis, University of Toronto, (2012), retrieved from http://hdl.handle.net/1807/33952.

Cragg, MS, et al., "Apparent modulation of CD20 by rituximab: an alternative explanation", Blood, 103(10), (2004), 3989-3990.

Deresiewicz, RL, et al., "Mutations Affecting the Activity of the Shiga-like Toxin I A-Chain", Biochemistry, 31(12), (1992), 3272-3280.

Di, R, et al., "Identification of amino acids critical for the cytotoxicity of Shiga toxin 1 and 2 in *Saccharomyces cerevisiae*", Toxicon, 57(4), (2011), 525-539.

Fanale, MA, et al., "Phase I/Ib study of the novel CD20-targeted immunotoxin MT-3724 in relapsed/refractory non-Hodgkin's B-cell lymphoma", Proceedings of the 107$^{th}$ Annual Meeting of the American Association for Cancer Research, Apr. 16-20, 2016, 76(14 Suppl), Abstract # CT049.

Fanale, MA, et al., "Phase I/Ib study of the novel CD20-targeted immunotoxin MT-3724 in relapsed/refractory non-Hodgkin's B-cell lymphoma", [abstract]. In: Proceedings of the 107$^{th}$ Annual Meeting of the American Association for Cancer Research, Cancer Research, Jul. 15, 2016, 76(14 Suppl), Abstract nr CT049.

(56) References Cited

OTHER PUBLICATIONS

Gannon, VP, et al., "Molecular cloning and nucleotide sequence of another variant of the *Escherichia coli* Shiga-like toxin II family", Journal of General Microbiology 136(6), (1990), 1125-1135.

Garred, O, et al., "Role of processing and intracellular transport for optimal toxicity of Shiga toxin and toxin mutants", Experimental Cell Research, 218(1), (1995), 39-49.

Ghetie, MA, et al., "Homodimers but not monomers of Rituxan (chimeric anti-CD20) induce apoptosis in human B-lymphoma cells and synergize with a chemotherapeutic agent and an immunotoxin", Blood, 97(5), (2001), 1392-1398.

Glennie, MJ, et al., "Mechanisms of killing by anti-CD20 monoclonal antibodies", Molecular Immunology, 44(16), (2007), 3823-3837.

Gordon, VM, et al., "An Enzymatic Mutant of Shiga-Like Toxin II Variant Is a Vaccine Candidate for Edema Disease of Swine", Infection and Immunity, 60(2), (1992), 485-490.

Goulet, AC, et al., "Conjugation of Blocked Ricin to an Anti-CD19 Monoclonal Antibody Increases Antibody-Induced Cell Calcium Mobilization and CD19 Internalization", Blood, 90(6), (1995), 2364-2375.

Haddad, JE, et al., "Minimum Domain of the Shiga Toxin A Subunit Required for Enzymatic Activity", Journal of Bacteriology, 175(16), (1993), 4970-4978.

Hexham, JM, et al., "Influence of relative binding affinity on efficacy in a panel of anti-CD3 scFv immunotoxins", Molecular Immunology, 38(5), (2001), 397-408.

Hiraga, J, et al., "Down-regulation of CD20 expression in B-cell lymphoma cells after treatment with rituximab-containing combination chemotherapies: its prevalence and clinical significance", Blood, 113(20), (2009), 4885-4893.

Hovde, CJ, et al., "Evidence that glutamic acid 167 is an active-site residue of Shiga-like toxin I", Proceedings of the National Academy of Sciences of the United States of America, 85(8), (1988), 2568-2572.

"International Application Serial No. PCT/US2014/023198, International Search Report dated Sep. 18, 2014 and published Oct. 9, 2014", 5 pgs.

"International Application Serial No. PCT/US2014/023198, Written Opinion", 7 pgs.

"International Application Serial No. PCT/US2014/023198, Preliminary Report on Patentability", 8 pgs.

"International Application Serial No. PCT/US2014/023231, International Search Report dated Oct. 24, 2014 and published Dec. 4, 2014", 3 pgs.

"International Application Serial No. PCT/US2014/023231, Written Opinion dated Oct. 24, 2014", 4 pgs.

"International Application Serial No. PCT/US2014/023231, Preliminary Report on Patentability", 7 pgs.

"International Application Serial No. PCT/US2014/019708, International Search Report dated Jun. 29, 2015 and published Sep. 17, 2015", 5 pgs.

"International Application Serial No. PCT/US2014/019708, Written Opinion", 8 pgs.

"International Application Serial No. PCT/US2014/019708, Preliminary Report on Patentability", 9 pgs.

Ishikawa, S, et al., "Protection against Shiga Toxin 1 Challenge by Immunization of Mice with Purified Mutant Shiga Toxin 1", Infection and Immunity, 71(6), (2003), 3235-3239.

Jackson, RL, et al., "Mutational analysis of the Shiga toxin and Shiga-like toxin II enzymatic subunits", Journal of Bacteriology 172(6), (1990), 3346-3350.

Jilani, I, et al., "Transient down-modulation of CD20 by rituximab in patients with chronic lymphocytic leukemia", Blood, 102(10), (2003), 3514-3520.

Jilani, I, et al., "Anti-idiotype versus anti-mouse Ig for detecting rituximab", Blood, 103(10), (2004), 3990.

Johannes, L, et al., "Shiga toxins—from cell biology to biomedical applications", Nature Reviews Microbiology, 8(2), (2010), 105-116.

Kim, GB, et al., "A fold-back single-chain diabody format enhances the bioactivity of an anti-monkey CD3 recombinant diphtheria toxin-based immunotoxin", Protein Engineering, Design & Selection, 20(9), (2007), 425-432.

Kurmanova, A, et al., "Structural requirements for furin-induced cleavage and activation of Shiga toxin", Biochemical and Biophysical Research Communications, 357(1), (2007), 144-149.

Kyu, E, "Characterization of the A subunit mutants of Stx1 and Stx2 in *Saccharomyces cerevisiae*", thesis, Rutgers, The State University of New Jersey, New Brunswick, retrieved from http://dx.doi.org/doi:10.7282/T34F1QWJ.

Lambert, J, et al., "Purified Immunotoxins That Are Reactive with Human Lymphoid Cells: Monoclonal antibodies conjugated to the ribosome-inactivating proteins gelonin and the pokeweed antiviral proteins", Journal of Biological Chemistry, 260(22), (1985), 12035-12041.

Lapointe, P, et al., "A Role for the Protease-sensitive Loop Region of Shiga-like Toxin 1 in the Retrotranslocation of Its $A_1$ Domain from the Endoplasmic Reticulum Lumen", The Journal of Biological Chemistry, 280(24), (2005), 23310-23318.

Law, CL, et al., "Efficient Elimination of B-Lineage Lymphomas by Anti-CD20-Auristatin Conjugates", Clinical Cancer Research, 10(23), (2004), 7842-7851.

Lea, N, et al., "Proteolytic cleavage of the A subunit is essential for maximal cytotoxicity of *Escherichia coli* O157:H7 Shiga-like toxin-1", Microbiology, 145(5), (1999), 999-1004.

Li, H, et al., "The CD20 Calcium Channel Is Localized to Microvilli and Constitutively Associated with Membrane Rafts: Antibody binding increases the affinity of the association through an epitope-dependent cross-linking-independent mechanism", Journal of Biological Chemistry, 279(19), (2004), 19893-19901.

Li, B et al., "Developmental of Novel Tetravalent Anti-CD20 Antibodies with Potent Antitumor Activity", Cancer Research 68(7), (2008), 2400-2408.

Lim, SH, et al., "Fc gamma receptor IIb on target B cells promotes rituximab internalization and reduces clinical efficacy", Blood, 118(9), (2011), 2530-2540.

Luqman, M, et al., "The antileukemia activity of a human anti-CD40 antagonist antibody, HCD122, on human chronic lymphocytic leukemia cells", Blood, 112(3), (2008), 711-720.

Mazor, Y, et al., "chFRP5-ZZ-PE38, a large IgG-toxin immunoconjugate outperforms the corresponding smaller FRP5(Fv)-ETA immunotoxin in eradicating ErbB2-expressing tumor xenografts", Cancer Letters, 257(1), (2007), 124-135.

McCluskey, AJ, "Shiga-like Toxin 1: Molecular Mechanism of Toxicity and Discovery of Inhibitors", thesis, University of Toronto, (2012), retrieved from http://hdl.handle.net/1807/32046.

McCluskey, AJ, et al., Charged and Hydrophobic Surfaces on the A Chain of Shiga-Like Toxin 1 Recognize the C-Terminal Domain of Ribosomal Stalk Proteins, PLoS One, 7(2), (2012), e31191.

Michel, RB, et al., "Intracellular Accumulation of the Anti-CD20 Antibody 1F5 in B-Lymphoma cells", Clinical Cancer Research, 8(8), (2002), 2701-2713.

Miller, K, et al., "Design, Construction, and In Vitro Analyses of Multivalent Antibodies", Journal of Immunology, 170(9), (2003), 4854-4861.

Noakes, KL, et al., "Exploiting retrograde transport of Shiga-like toxin 1 for the delivery of exogenous antigens into the MHC class I presentation pathway", FEBS Letters, 543(1-2), (1999), 95-99.

Ohmura, M, et al., "Characterization of non-toxic mutant toxins of Vero toxin 1 that were constructed by replacing amino acids in the A subunit", Microbial Pathogenesis, 15(3), (1993), 169-176.

Olafsen, T, et al., "Recombinant Anti-Cd20 Antibody Fragments for Small-Animal PET Imaging of B-Cell Lymphomas", Journal of Nuclear Medicine, 50(9), (2009), 1500-1508.

Olafsen, T, et al., "ImmunoPET imaging of B-cell lymphoma using $^{124}$I-anti-CD20 scFv dimers (diabodies)", Protein Engineering, Design & Selection, 23(4), (2010), 243-249.

Oloomi, M, et al., "In vivo Characterization of Fusion Protein Comprising of A1 Subunit of Shiga Toxin and Human GM-CSF: Assessment of Its Immunogenicity and Toxicity", Iranian Biomedical Journal, 14(4), (2010), 136-141.

(56) References Cited

OTHER PUBLICATIONS

Perapalam, S, Cell-Targeted Ribosome-Inactivating Proteins Derived From Protein Combinatorial Libraries, thesis, University of Toronto (Apr. 1, 2008).

Pirie, CM, et al., "Convergent Potency of Internalized Gelonin Immunotoxins across Varied Cell Lines, Antigens, and Targeting Moieties", Journal of Biological Chemistry, 286(6), (2011), 4165-4172.

Polito, L, et al., "The conjugate Rituximab/saporin-S6 completely inhibits clonogenic growth of CD20-expressing cells and produces a synergistic toxic effect with Fludarabine", Leukemia, 18(7), (2004), 1215-1222.

Polson, AG, et al., "Antibody-Drug Conjugates for the Treatment of Non-Hodgkin's Lymphoma: Target and Linker-Drug Selection", Cancer Research, 69(6), (Jan. 1, 2009), 2358-2364.

Press, OW, et al., "Endocytosis and Degradation of Monoclonal Antibodies Targeting Human B-Cell Malignancies", Cancer Research, 49(17), (1989), 4906-4912.

Press, OW, et al., "Retention of B-Cell-Specific Monoclonal Antibodies by Human Lymphoma Cells", Blood, 83(5), (1994), 1390-1397.

Protein ID ABM97743, European Molecular Biology Laboratory (EMBL), Oloomi, M, et al., "synthetic construct partial A1-GMCSF chimeric protein", Sep. 10, 2007.

Rajagopalan, S, et al., "CD20-Specific Engineered Toxin Body Demonstrates Direct Cell Kill of Multiple B-Cell Non-Hodgkin's Lymphoma Types", Blood, 122(21), (2013), 5152.

Rajagopalan, S, et al., "CD20-specific Engineered Toxin Body demonstrates direct cell kill of multiple B-cell Non-Hodgkin's lymphoma types", Proceedings: American Association for Cancer Research (AACR) Annual Meeting 2014, Abstract #647, (Apr. 5-9, 2014).

Rajagopalan, S, et al., "CD20-specific Engineered Toxin Body demonstrates direct cell kill of multiple B-cell Non-Hodgkin's lymphoma types", [abstract]. In: Proceedings of the $105^{th}$ Annual Meeting of the American Association for Cancer Research, Cancer Research, Oct. 1, 2014, 74(19 Suppl), Abstract nr 647.

Robinson, GL, et al., "MT-3724, an engineered toxin body targeting CD20 for non-Hodgkin's lymphoma", Proceedings: American Association for Cancer Research (AACR) 107th Annual Meeting 2016, Abstract #1483, (Apr. 6-10, 2016).

Robinson, GL, et al., "MT-3724, an engineered toxin body targeting CD20 for non-Hodgkin's lymphoma", [abstract]. In: Proceedings of the $107^{th}$ Annual Meeting of the American Association for Cancer Research, Cancer Research, Jul. 15, 2016, 76(14 Suppl), Abstract nr 1483.

Rossi, EA, et al., "Novel Designs of Multivalent Anti-CD20 Humanized Antibodies as Improved Lymphoma Therapeutics", Cancer Research 68(20), (2008), 8384-8392.

Roudkenar, MH, et al., "Selective cytotoxicity of recombinant STXA1-GM-CSF protein in hematopoetic cancer cells", Cell Biology and Toxicology, 22(3), (2006), 213-219.

Sandvig, K, et al., "Entry of Shiga Toxin into Cells", Zentralblatt für Bakteriologie, 278(2-3), (1993), 296-305.

Schultz, J, et al., "A Tetravalent Single-chain Antibody-Streptavidin Fusion Protein for Pretargeted Lymphoma Therapy", Cancer Research, 60(23), (2000), 6663-6669.

Shan, D, et al., "Characterization of scFv-Ig Constructs Generated from the Anti-CD20 mAb 1F5 Using Linker Peptides of Varying Lengths", Journal of Immunology, 162(11): (1999) 6589-6595.

Shen, GL, et al., "Evaluation of Four CD22 Antibodies as Ricin A Chain-Containing Immunotoxins for the in Vivo Therapy of Human B-Cell Leukemias and Lymphomas", International Journal of Cancer, 42(5): (1988), 792-797.

Shete, V, "Generation and Characterization of Random Site-Directed Mutants of Shiga-Like Toxin 1A by *Escherichia coli* O157:H7 in *Saccharomyces cerevisiae*", thesis, Rutgers, The State University of New Jersey, New Brunswick, (2009), retrieved from http://dx.doi.org/doi:10.7282/T300029Z.
Sieber, T, et al., "Selective internalization of monoclonal antibodies by B-cell chronic lymphocytic leukaemia cells", 121(3), (2003), 458-461.
Skinner, LM, and Jackson, MP, "Investigation of ribosome binding by the Shiga toxin A1 subunit, using competition and site-directed mutagenesis", Journal of Bacteriology, 179(4), (1997), 1368-1374.
Skinner, LM, and Jackson, MP, "Inhibition of prokaryotic translation by the Shiga toxin enzymatic subunit", Microbial Pathogenesis, 24(2), (1998), 117-122.
Suhan, ML, and Hovde, CJ, "Disruption of an Internal Membrane-Spanning Region in Shiga Toxin 1 Reduces Cytotoxicity", Infection and Immunity, 66(11), (1998), 5252-5259.
Thompson, J, et al., "Improved binding of a bivalent single-chain immunotoxin results in increased efficacy for in vivo T-cell depletion", Protein Engineering 14(12), (2001), 1035-1041.
Varner, CT, et al., "Recent Advances in Engineering Polyvalent Biological Interactions", Biomacromolecules, 16(1), (2014), 43-55.
Willert, EK, et al., "Engineered toxin bodies: A next-generation immunotoxin scaffold with novel immuno-oncology functionality", American Association for Cancer Research (AACR) Annual Meeting 2015, Poster, Abstract #2477, (Apr. 18-22, 2016).
Willert, EK, et al., "Engineered toxin bodies: A next-generation immunotoxin scaffold with novel immuno-oncology functionality", [abstract]. In: Proceedings: American Association for Cancer Research Annual Meeting 2015, (Apr. 18-22, 2015), Abstract nr 2477.
Wirth, R, et al., "Engineered Toxin Body demonstrating CD20-specific binding and cell kill in B-Cell Non-Hodgkin lymphoma cells", Proceedings: American Association for Cancer Research (AACR) 104th Annual Meeting 2013, Abstract #5477, (Apr. 6-10, 2013).
Wirth, R, et al., "Engineered Toxin Body demonstrating CD20-specific binding and cell kill in B-Cell Non-Hodgkin lymphoma cells", [abstract]. In: Proceedings of the $104^{th}$ Annual Meeting of the American Association for Cancer Research, Cancer Research, Apr. 15, 2013, 73(8 Suppl), Abstract nr 5477.
Wu, AM, et al., "Multimerization of a chimeric anti-CD20 single-chain Fv-Fc fusion protein is mediated through variable domain exchange", Protein Engineering, 14(12), (2001), 1025-1033.
Yamasaki, S, et al., "Importance of arginine at position 170 of the A Subunit of Vero toxin 1 produced by enterohemorrhagic *Escherichia coli* for toxin activity", Microbial Pathogenesis, 11(1), (1991), 1-9.
Cuesta, AM, et al., "Multivalent antibodies: when design surpasses evolution", Trends in Biotechnology, 28(7), (2010), 355-362.
Haisma, HJ, et al., "Construction and Characterization of a Fusion Protein of Single-Chain Anti-CD20 Antibody and Human for Antibody-Directed Enzyme Prodrug Therapy", Blood, 92(1), (1998), 184-190.
Hamlin, PA, et al., "Safety and Efficacy of Anti-CD20 Immunotoxin MT-3724 in Relapsed/Refractory B-cell Non-Hodgkin Lymphoma (NHL) in a Phase 1 Study", 2018 American Society of Clinical Oncology Annual Meeting, Abstract 7580, (Jun. 4, 2018).
Jubala, CM, et al., "CD20 Expression in Normal Canine B cells and in Canine non-Hodgkin Lymphoma", Veterinary Pathology, 42(4), (2005), 468-476.
Paul, WE, *Fundamental Immunology*, $3^{rd}$ ed., Raven Press, NY, (1993), 292-295.
Rudikoff, S, et al., "Single amino acid substitution altering antigen-binding specificity", Proceedings of the National Academy of Sciences of the United States of America, 79(6), (1982), 1979-1983.
"U.S. Appl. No. 15/290,266, Office Action dated Jun. 27, 2018", 32 pgs.
Wargalla, UC, and Reisfeld, RA, "Rate of internalization of an immunotoxin correlates with cytotoxic activity against human tumor cells", Proceedings of the National Academy of Sciences of the United States of America, 86(13), (1989), 5146-5150.
Yu, L, et al., "Interaction between Bevacizumab and Murine VEGF-A: A Reassessment", Investigative Ophthalmology & Visual Science, 49(2), (2008), 522-527.
Ewers, H., and Helenius, A., "Lipid-Mediated Endocytosis", Cold Spring Harbor Perspectives in Biology 3 (8), (2011), 1-14.

(56) References Cited

OTHER PUBLICATIONS

Bevan, N., et al., Real-time 96-well antibody internalization assays using IncuCyte® FabFluor Red Antibody Labeling Reagent, Application Note, Sartorius, 2017 Essen BioScience.

* cited by examiner

Figure 1A. Schematic Representations of Exemplary, Multivalent CD20-Binding Molecules of the Present Invention That Are Bivalent

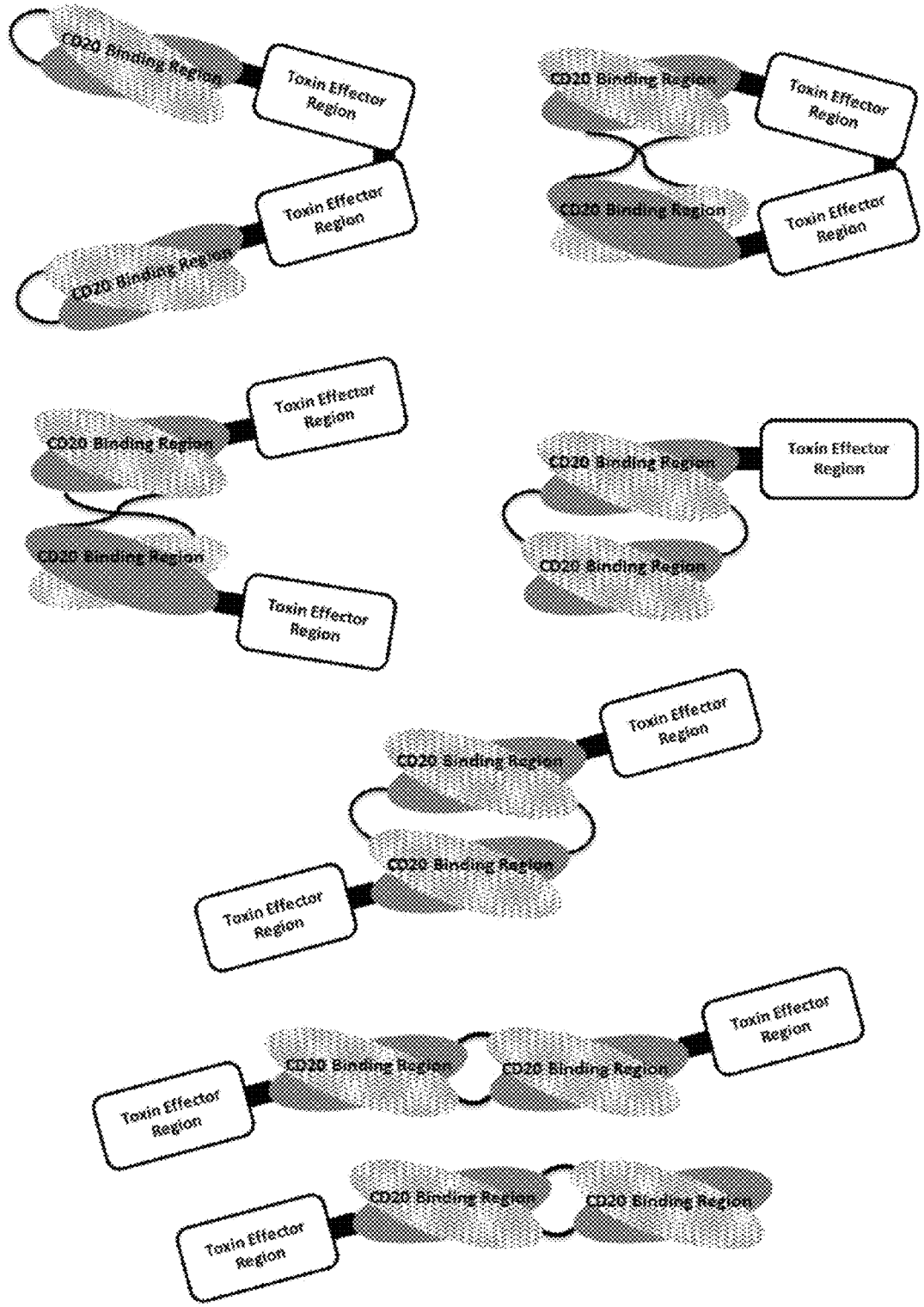
Figure 1B. Schematic Representations of Exemplary, Bivalent CD20-Binding Molecules of the Present Invention Comprising Immunoglobulin-Derived, CD20-Binding Regions

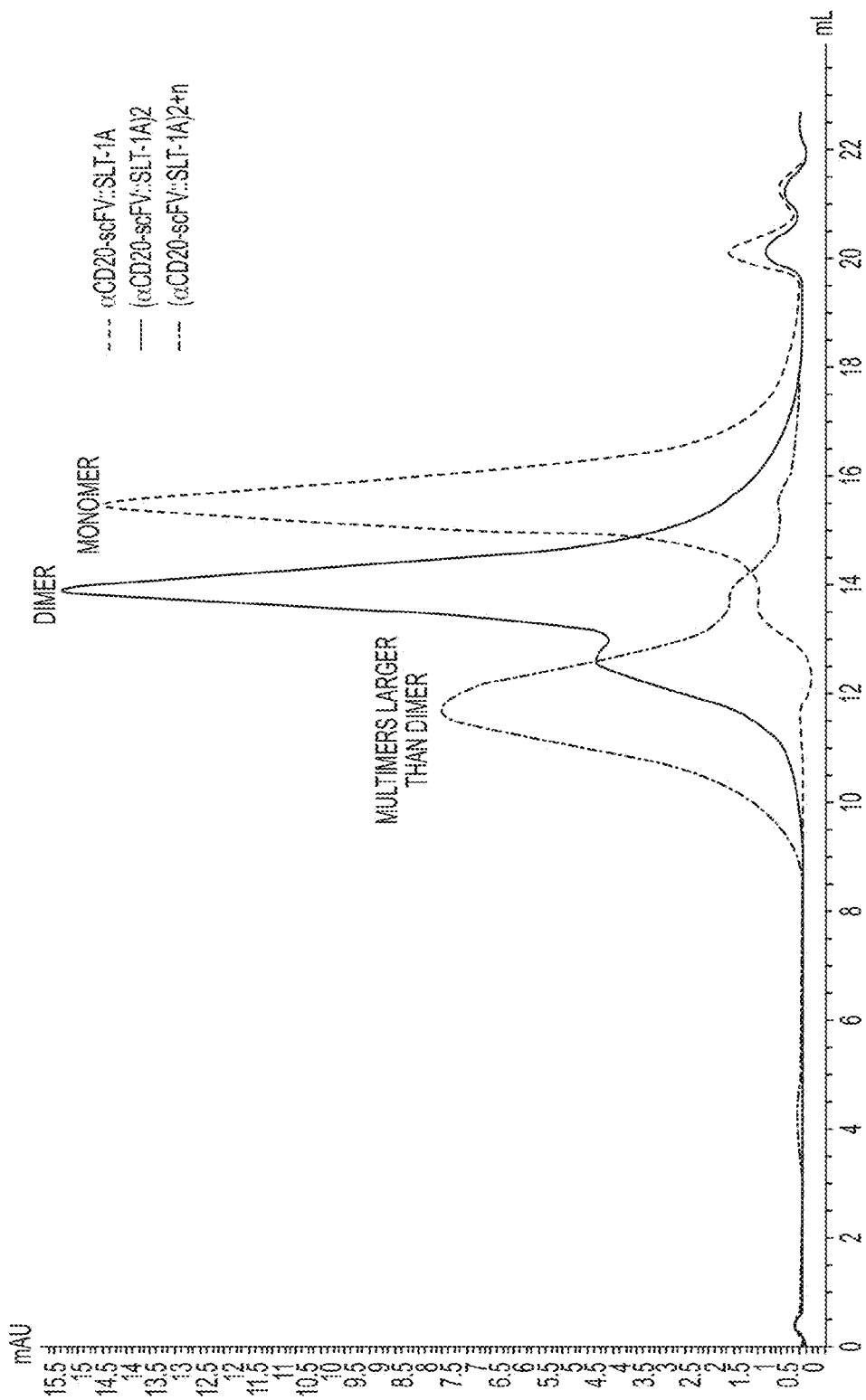
Figure 2. Size Exclusion Chromatography Profiles of Compositions Comprising Multivalent CD20-Binding Molecules of the Present Invention Figure 3. Coomassie-Stained, SDS-PAGE Gel Showing Exemplary, Multivalent, CD20-Binding Molecules of the Present Invention: Proteinaceous molecules present in reduced and non-reduced samples of different pools of purified CD20-binding molecules

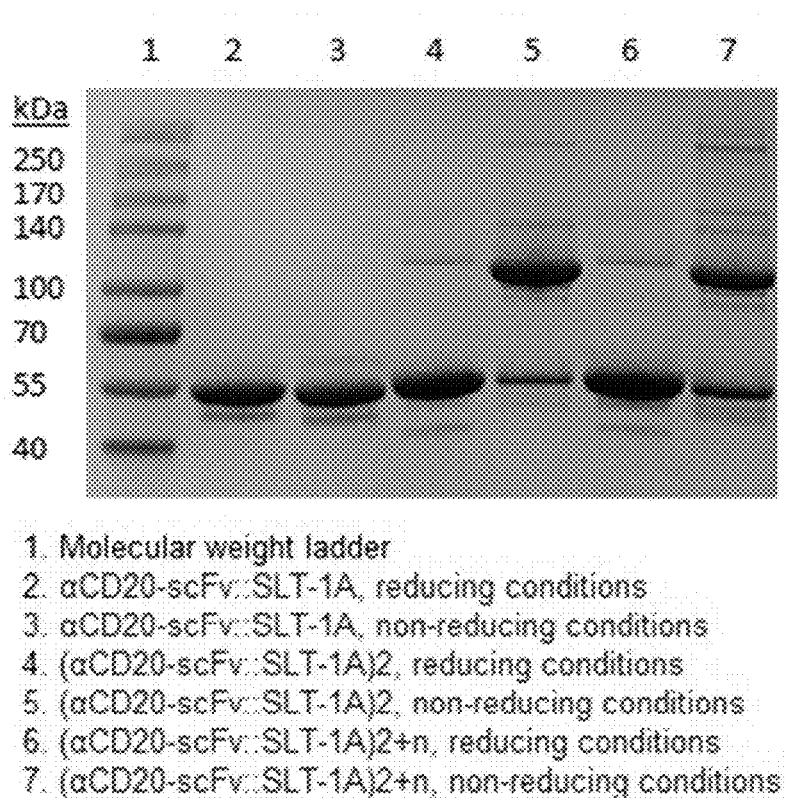

1. Molecular weight ladder
2. αCD20-scFv::SLT-1A, reducing conditions
3. αCD20-scFv::SLT-1A, non-reducing conditions
4. (αCD20-scFv::SLT-1A)2, reducing conditions
5. (αCD20-scFv::SLT-1A)2, non-reducing conditions
6. (αCD20-scFv::SLT-1A)2+n, reducing conditions
7. (αCD20-scFv::SLT-1A)2+n, non-reducing conditions

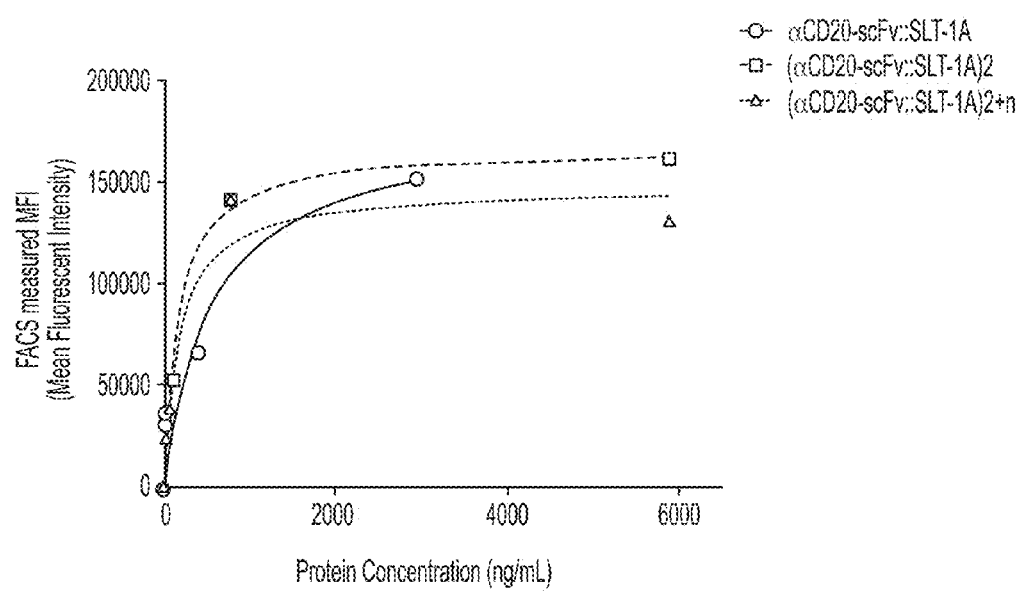
Figure 4. Binding Characteristics of Exemplary, Multivalent CD20-Binding Molecule Compositions of the Present Invention to CD20 Positive Cells Figure 5. *In Vitro*, Ribosomal Inhibitory Activities of Exemplary, Multivalent CD20-Binding Molecules of the Present Invention
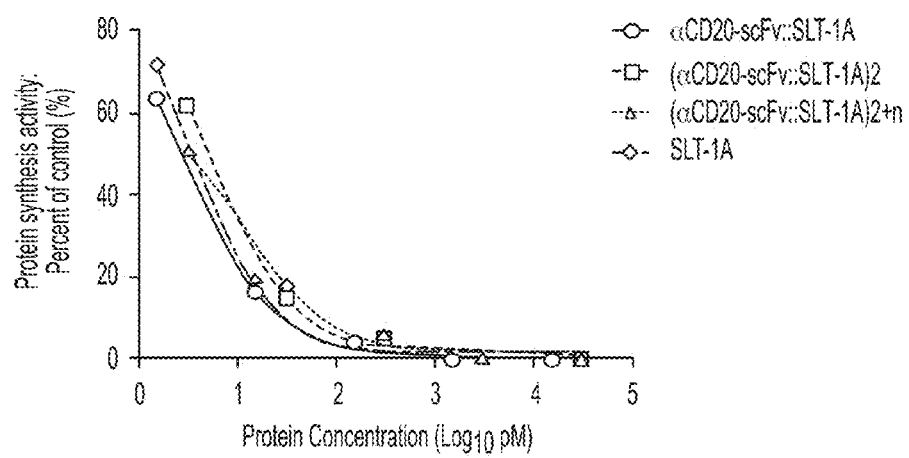
Figure 6. Cytotoxicities of Exemplary, Multivalent CD20-Binding Molecule Compositions of the Present Invention as Compared to a Monovalent CD20-Binding Protein Composition
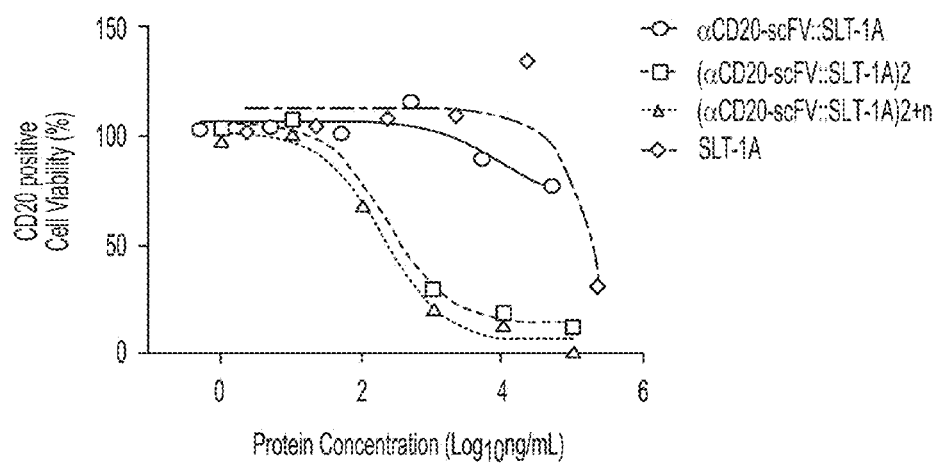

Figure 7. Cytotoxicity of an Exemplary, Multivalent CD20-Binding Molecule Composition of the Present Invention as Compared to Monovalent CD20-Binding Protein Compositions
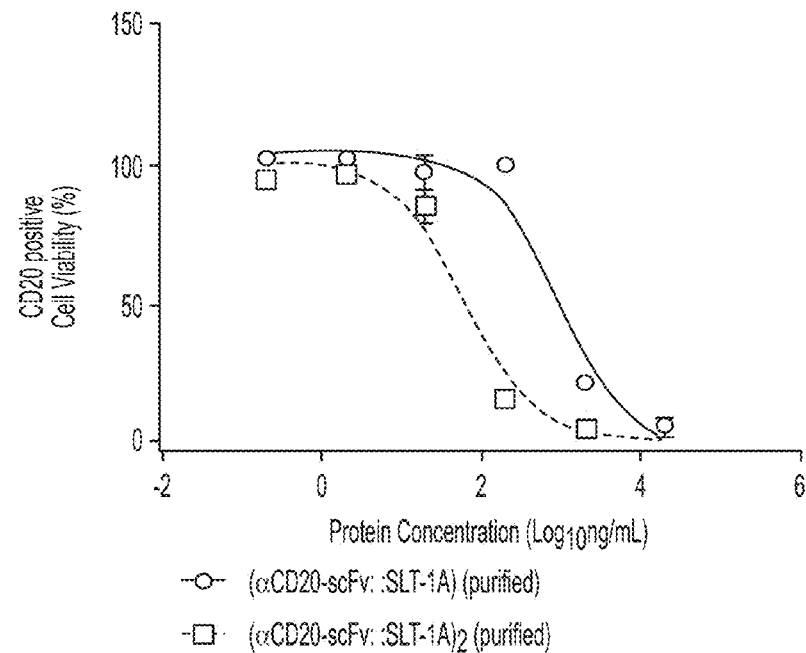
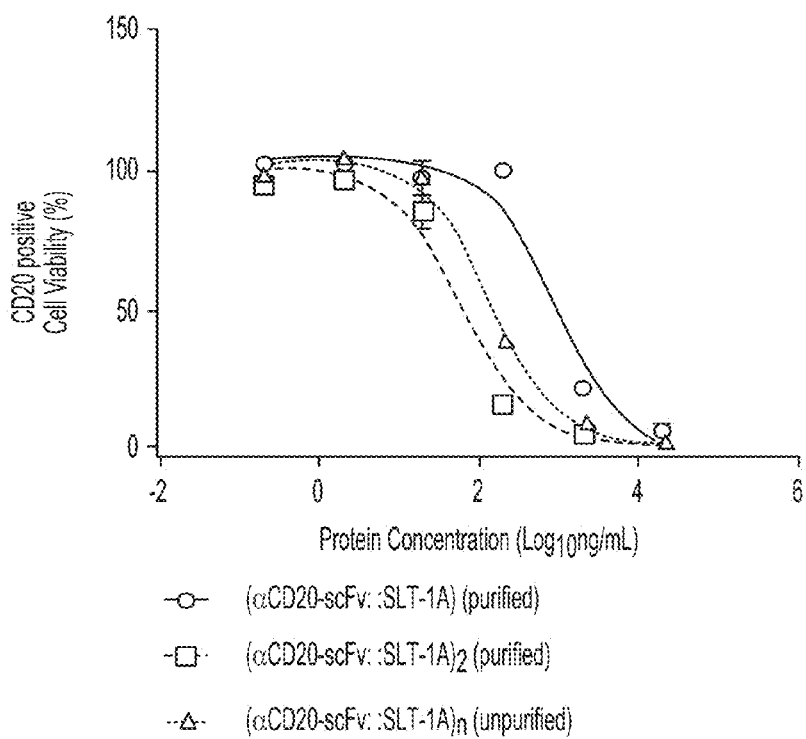

Figure 8. Cytotoxicities of CD20-Binding Protein Compositions Comprising Different Ratios of Monovalent CD20-Binding Protein to Multivalent CD20-Binding Proteins
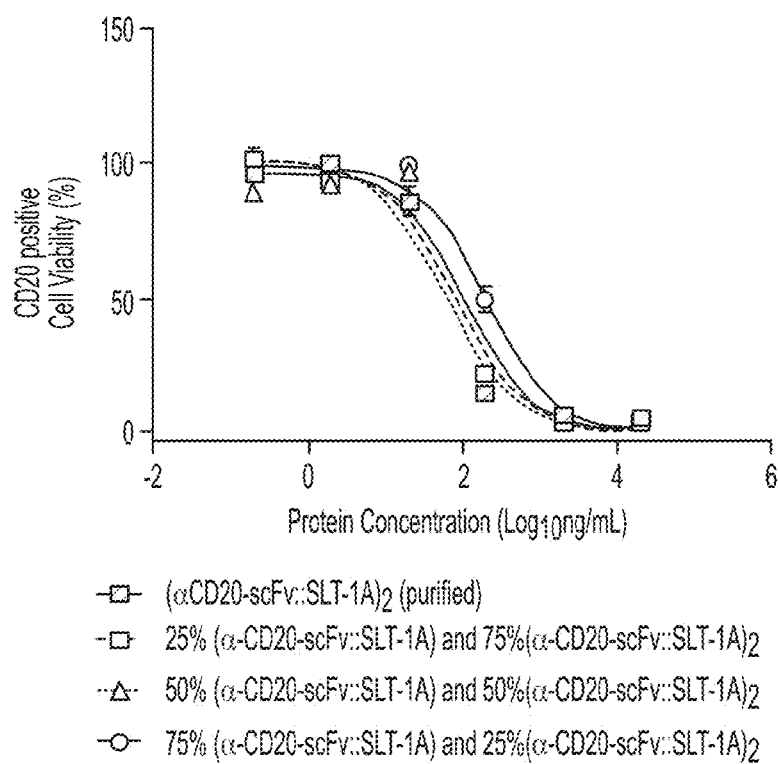

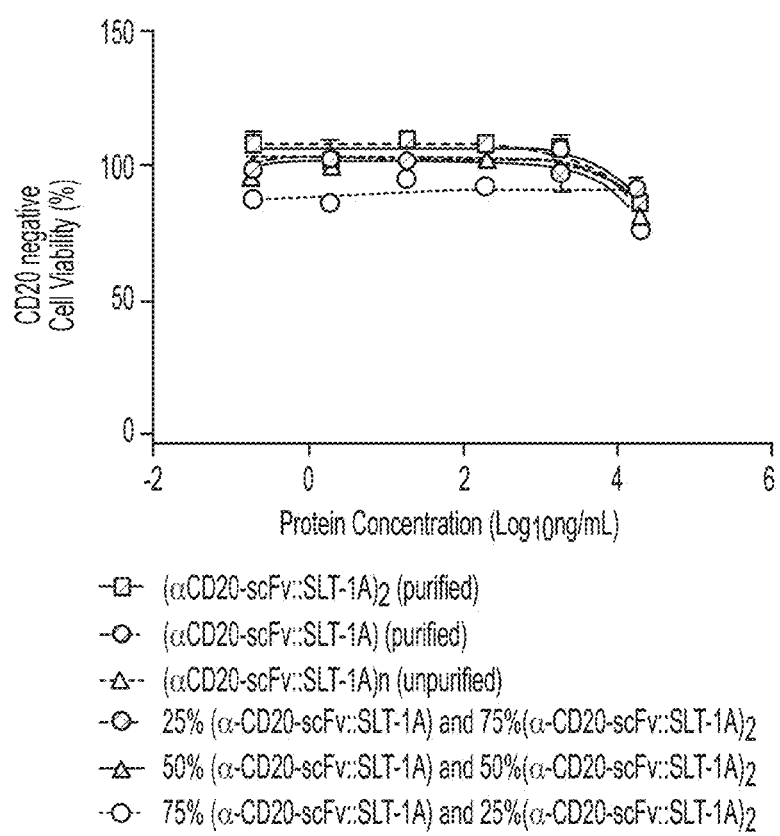
Figure 9. Lack of Untargeted Cytotoxicity of Exemplary, CD20-Binding Molecule Compositions of the Present Invention to CD20 Negative Cells Figure 10. Cytotoxicities of Fixed-Ratio Mixtures of the Monovalent αCD20-scFv::SLT-1A Composition with the Multivalent (αCD20-scFv::SLT-1A)$_2$ Composition 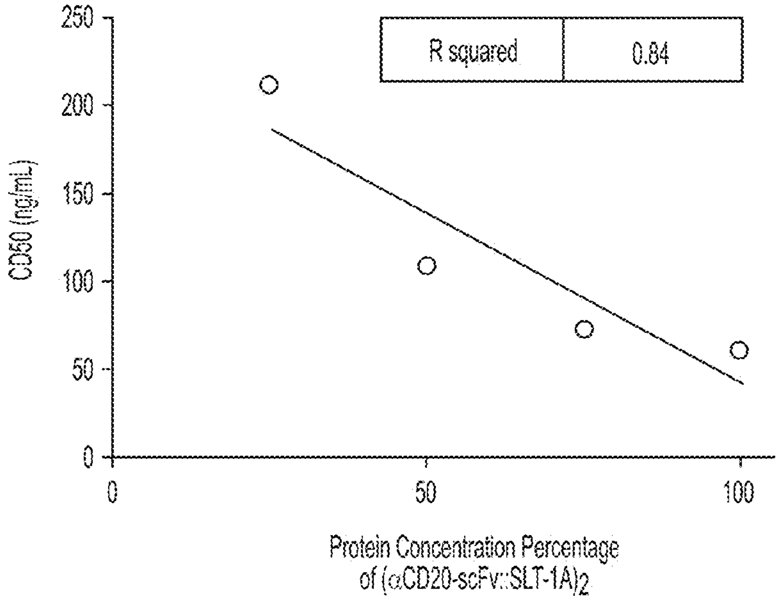 Figure 11. Cytotoxicities of Fixed-Ratio Mixtures of the Monovalent αCD20-scFv::SLT-1A Composition with the Multivalent (αCD20-scFv::SLT-1A)$_2$ Composition

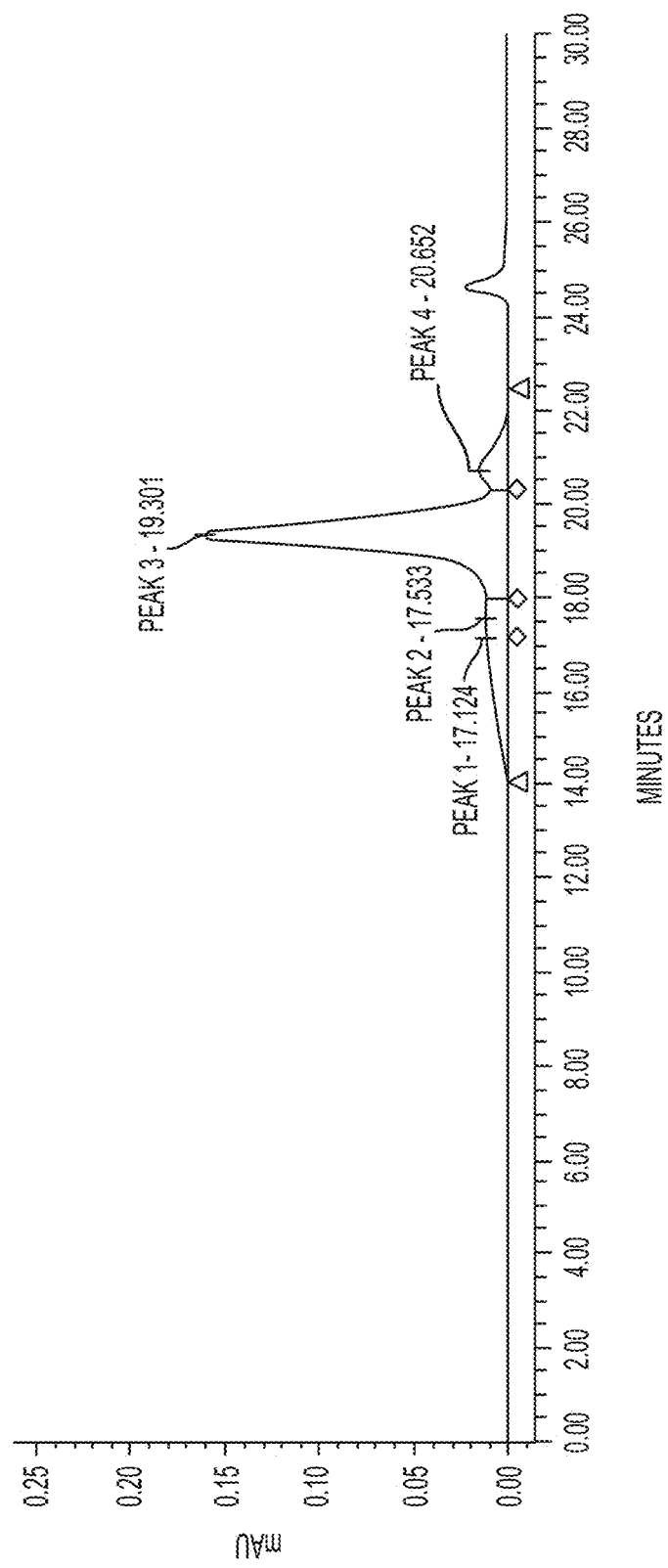
Figure 12A. Size-Exclusion Chromatography Profiles of Exemplary, Multivalent CD20-Binding Molecule Compositions of the Present Invention

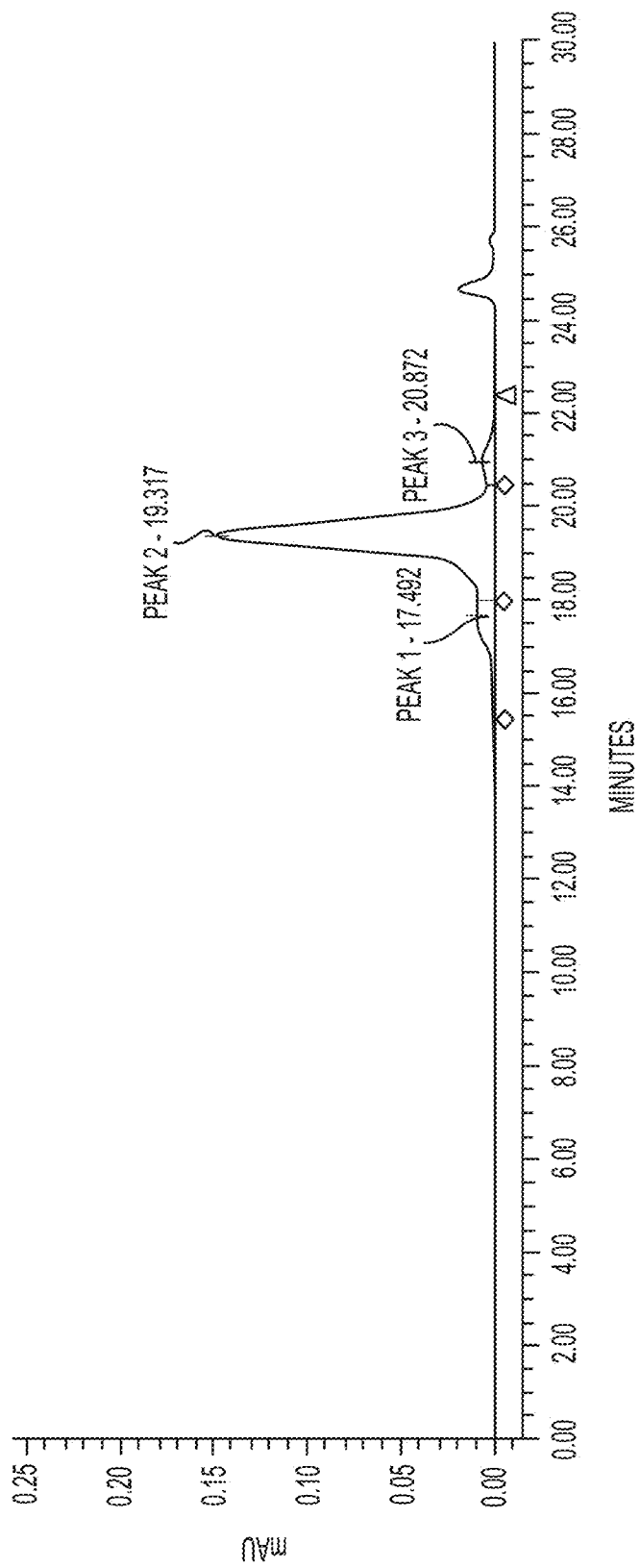
Figure 12B. Size-Exclusion Chromatography Profiles of Exemplary, Multivalent CD20-Binding Molecule Compositions of the Present Invention

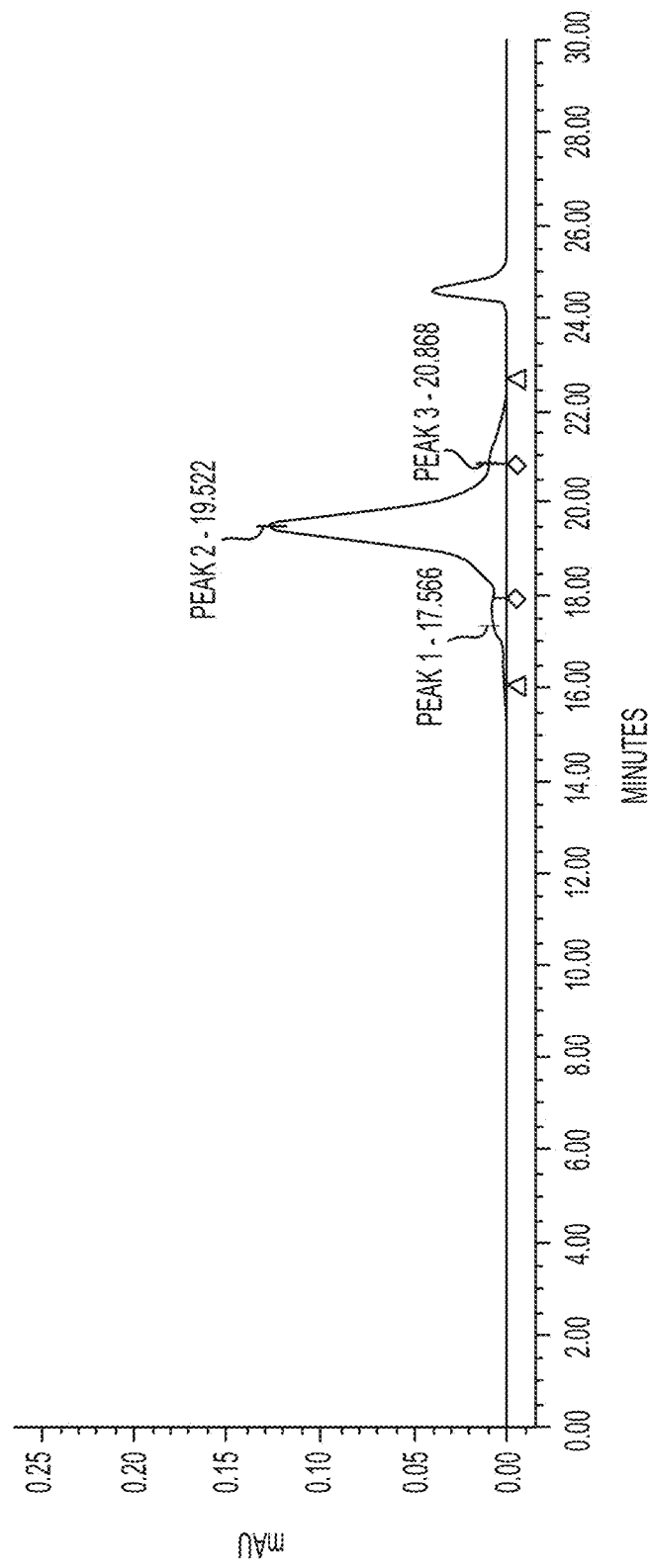
Figure 12C. Size-Exclusion Chromatography Profiles of Exemplary, Multivalent CD20-Binding Molecule Compositions of the Present Invention

MULTIVALENT CD20-BINDING MOLECULES COMPRISING SHIGA TOXIN A SUBUNIT EFFECTOR REGIONS AND ENRICHED COMPOSITIONS THEREOF

SEQUENCE LISTING

The instant application contains a Sequence Listing which has been submitted electronically in ASCII format and is hereby incorporated by reference in its entirety. Said ASCII copy, created on Jun. 9, 2017, is named 15-01PCT-USSL.txt and is 1,248,483 bytes in size.

TECHNICAL FIELD

The present invention relates to multivalent CD20-binding molecules comprising multiple CD20-binding regions and optionally one or more toxin effector regions, such as, e.g., a Shiga toxin effector region derived from the A Subunit of a member(s) of the Shiga toxin family, and compositions enriched with one or more of the aforementioned molecules. The multivalent CD20-binding molecules of the present invention, and compositions thereof, have uses, e.g., for the selective killing of CD20-expressing cells and as therapeutics for the treatment of a variety of diseases, disorders, and conditions, which include cancers, tumors, and/or immune disorders.

BACKGROUND

The development of synthetic fusion proteins from toxins that are effective as therapeutics has challenged scientists for decades (Pastan I et al., *Annu Rev Med* 58: 221-37 (2007)). The potency of recombinant cytotoxic proteins derived from toxins depends on each protein's efficiency in various cellular processes, including receptor internalization, intracellular routing, and delivering an enzymatically active, toxin moiety to cytosolic, target substrates in order to efficiently target and kill cells (Du X et al., *Cancer Res* 68: 6300-5 (2008); Pirie C et al., *J Biol Chem* 286: 4165-72 (2011)).

Naturally occurring toxins or truncated toxin fragments have been linked or fused to immunoglobulin domains or receptor ligands through chemical conjugation or recombinant protein engineering techniques with the hope of creating cell-targeted therapeutic molecules (Moolten F. Cooperband S, *Science* 169: 68-70 (1970); Thorpe P et al., *Nature* 271: 752-5 (1978); Krolick K et al., *Proc Natl Acad Sci USA* 77: 5419-23 (1980); Krolick K et al., *Cancer Immunol Immunother* 12: 39-41 (1981); Blythman H et al., *Nature* 290: 145-46 (1981); Chaudhary V et al., *Nature* 339: 394-7 (1989); Strom T et al., *Semin Immunol* 2: 467-79 (1990); Pastan I et al., *Annu Rev Biochem* 61: 331-54 (1992); Foss F et al., *Curr Top Microbiol Immunol* 234: 63-81 (1998)). The aim of such molecular engineering techniques is to design chimeric molecules with the dual functionality of: 1) delivering toxins to specific cell types or places within an organism after systemic administration; and 2) effectuating a targeted cytotoxicity to specific cells using potent cytotoxicity mechanisms effective in eukaryotic cells.

There is an unsolved problem in targeting extracellular CD20 antigens with therapeutics that require cell internalization for efficacy—how to efficiently drive the therapeutic agents bound to cell surface CD20 molecules inside target cells. CD20 is a particularly attractive target for antibody-based therapies based on mechanisms in which it is desirable for a therapeutic agent to remain on the cell surface because CD20 does not internalize after being bound by antibodies. Although the lack of CD20 internalization was later proven to be both cell type- and antibody type-specific, in general, CD20 appears to internalize at a much lower rate than do other cell surface antigens and is generally considered a non-internalizing, extracellular target. CD20 is "resistant to internalization and remains on the cell surface with its bound mAb for extended periods of hours and perhaps days" (Glennie M et al., *Mol Immunol* 44: 3823-37 (2007); see e.g. Press O et al., *Cancer Res* 49: 4906-12 (1989); McLaughlin P et al., *J Clin Oncol* 16: 2825-33 (1998); Johnson P, Glennie M, *Semin Oncol* 30: 3-8 (2003)).

Although antibody-based therapies targeting extracellular CD20 antigens are numerous, they are thus commonly based on extracellular mechanisms (see Cheson B, Leonard J, *N Engl J Med* 359: 613-26 (2008); Boross P. Leusen J, *Am J Cancer Res* 2: 676-90 (2012)). There is a question in the art as to the utility of CD20 as an extracellular target for therapies whose effectiveness requires a therapeutic agent to reach an intracellular space of a target cell in a CD20-mediated fashion because of the general finding that CD20 does not readily internalize.

The effectiveness of therapies relying on cellular internalization of a therapeutic, such as, e.g., immunotoxins, ligand-toxin fusions, and immuno-RNases, depends on both the quantity of their target on the surface of target cells and the rate of cellular internalization of a surface-bound therapeutic complexed with its target. For CD20 in particular, there is an unsolved problem in targeting extracellular CD20 with internalizing therapeutics—how to efficiently drive therapeutic agents bound to cell-surface CD20 molecules into the interior of target cells. The general resistance of CD20 to cellular internalization means that this unsolved problem of promoting efficient CD20 internalization applies generally to any CD20-expressing target cell, including cells that express relatively large quantities of CD20 on their cellular surfaces.

There is a need in the art to develop effective compositions, therapeutic molecules, and therapeutic methods which target cells expressing cell-surface CD20 where CD20 does not efficiently internalize upon therapeutic binding, such as, e.g., by an immunoglobulin binding domain. In particular, there is a need in the art to develop CD20-targeted molecules that trigger rapid and efficient cellular internalization of cell-surface CD20 molecules. For example, immunotoxins which actively induce cellular internalization of cell-surface expressed CD20 molecules, which intracellularly route toxin components to their targets, and which are capable of potently killing CD20-expressing cells are desirable for the development of effective CD20-targeted, anti-neoplastic and immuno-modulatory therapeutics. Such cell-targeted therapies may be used for the targeted killing of CD20-expressing cells, such as, e.g., certain malignant cells, B-lymphocytes (B-cells), and T-lymphocytes (T-cells). New therapies are especially needed for patients who are insensitive or develop resistance to current CD20-targeted therapies relying on extracellular mechanisms, such as, e.g., immune mechanisms based on signaling function(s) of an immunoglobulin domain like a fragment crystallizable Fc region (Fc region) interaction(s) with a Fc receptor(s) or the complement system.

There accordingly remains a need in the art for CD20-binding molecules which exhibit efficient and effective cellular internalization, intracellular-routing, and/or potent cytotoxicity toward CD20-expressing cells. In particular, there is a need in the art to develop effective compositions, therapeutics, and therapeutic methods targeting cell-surface CD20 antigens which do not naturally internalize at an efficient rate or upon binding by a therapeutic agent. In addition, it would be desirable to have improved, cell-targeting molecules which comprise Shiga-toxin-Subunit-A derived polypeptides that self-direct their own cellular internalization, intracellular routing, and/or display potent cytotoxicity for killing specific CD20-expressing cell types and for use in therapies for the treatment of a variety of diseases, such as, e.g., cancers, tumors, and immune disorders that can be treated by the selective killing of, or the selective delivery of an agent into, a targeted, CD20-expressing cell type.

SUMMARY OF THE INVENTION

The present invention provides various embodiments of multivalent CD20-binding molecules, and compositions thereof, wherein each multivalent CD20-binding molecule comprises 1) two or more CD20 binding regions, such as a binding region derived from an immunoglobulin, and 2) at least one Shiga toxin A Subunit effector polypeptide region derived from the A Subunit of at least one member of the Shiga toxin family. The CD20 binding regions of the multivalent CD20-binding molecules of the present invention are each, on its own, capable of specifically binding an extracellular part of a CD20, such as, e.g., a part of a CD20 exposed to the extracellular environment when CD20 is expressed at a cellular surface by a cell and remains physically coupled to the cell.

The linking of multiple CD20 binding regions with one or more Shiga toxin A Subunit-derived polypeptides enables the engineering of CD20-targeting molecules that can promote rapid cellular internalization of cell-surface CD20 and thus efficiently enter the interiors of CD20-expressing cells. Therefore, certain multivalent CD20-binding molecules of the present invention, and compositions thereof, may be used to selectively deliver cargo(s) to a CD20-expressing cell type(s) in the presence of one or more other cell types based on its CD20-targeting and cellular internalization activity(ies), such as, e.g., a cargo having a desired, intracellular function. In addition, certain multivalent CD20-binding molecules of the present invention, and compositions thereof, may be used to selectively kill a CD20-expressing cell in the presence of one or more other cell types based on its CD20-targeting activity and cellular internalization activity(ies), such as, e.g., by delivering into the interior of the targeted, CD20-expressing cell a component of the multivalent CD20-binding molecule which is cytotoxic at an intracellular location. For example, certain multivalent CD20-binding molecules of the present invention may be potently cytotoxic to CD20-expressing cells via their abilities to efficiently deliver into the interior of a CD20-expressing cell a catalytically active. Shiga toxin effector polypeptide(s) that is able to effectively route to the cytosol.

In certain embodiments, the multivalent CD20-binding molecule of the present invention comprises (1) two or more CD20 binding regions, each capable of specifically binding an extracellular part of a CD20 molecule; and (2) one or more Shiga toxin effector regions, each comprising a polypeptide derived from the amino acid sequence of the A Subunit of at least one member of the Shiga toxin family. In certain embodiments, the multivalent CD20-binding molecule of the present invention comprises (1) two or more CD20 binding regions, each capable on its own of specifically binding an extracellular part of a CD20 molecule; and (2) one or more Shiga toxin effector regions, each comprising a polypeptide derived from the amino acid sequence of the A Subunit of at least one member of the Shiga toxin family. In certain further embodiments, the multivalent CD20-binding molecule of the present invention does not comprise an immunoglobulin Fc region or any immunoglobulin domain required for an extracellular mechanism(s) of cell killing other than a domain(s) required for antigen binding. In certain further embodiments, the multivalent CD20-binding molecule does not comprise any immunoglobulin domains other than (1) six or more CDRs or (2) one or more single-chain variable fragments. In certain embodiments, the multivalent CD20-binding molecule of the present invention comprises only two, Shiga toxin effector regions.

For certain embodiments of the multivalent CD20-binding molecule of the present invention, upon administration of the multivalent CD20-binding molecule to a cell physically coupled with CD20, which have the extracellular part bound by two or more CD20 binding regions of the multivalent CD20-binding molecule, results in one or more of the following: (1) internalizing the multivalent CD20-binding molecule inside the cell, (2) subcellular routing of a Shiga toxin effector region of the multivalent CD20-binding molecule to the cell's cytosol, (3) disrupting the cell's ribosome function, and (4) killing of the cell. For certain further embodiments, the internalizing occurs in about five hours, four hours, three hours, two hours, one hour, thirty minutes, or less at a physiological temperature appropriate for the cell and/or at about 37 degrees Celsius. For certain further embodiments, the multivalent CD20-binding molecule induces cellular internalization of a molecular complex comprising the multivalent CD20-binding molecule bound to CD20. For certain further embodiments, the cell expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, the cell is a CD20 positive cell. For certain embodiments, the cell is physically coupled with a significant amount of extracellular CD20 which (1) have the extracellular part bound by the two or more CD20 binding regions of the multivalent CD20-binding molecule. For certain embodiments, the cell is a descendant or member of a B-cell lineage. For certain embodiments, the cell is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell. Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For certain embodiments of the multivalent CD20-binding molecule of the present invention, upon administration of the multivalent CD20-binding molecule to a plurality of cells physically coupled with CD20, which have the extracellular part bound by two or more CD20 binding regions of the multivalent CD20-binding molecule, results in one or more of the following activities: (1) internalizing the multivalent CD20-binding molecule inside the cell, (2) subcellular routing of a Shiga toxin effector region of the multivalent CD20-binding molecule to the cell's cytosol, (3) disrupting the cell's ribosome function, and (4) killing of the cell. For certain further embodiments, the multivalent CD20-binding molecule induces cellular internalization of a molecular complex comprising the multivalent CD20-binding molecule bound to CD20. For certain further embodiments, upon administration of the multivalent CD20-binding molecule to a plurality of cells physically coupled with CD20, which have the extracellular part bound by two or more CD20 binding regions of the multivalent CD20-binding molecule, at a concentration of multivalent CD20-binding molecule equivalent to five or thirty-eight percent to fifty percent cell-surface occupancy, the majority of the multivalent CD20-binding molecule internalizes into the plurality of cells in about five hours, four hours, three hours, two hours, one hour, thirty minutes, or less at a physiological temperature appropriate for the cell and/or at about 37 degrees Celsius. For certain further embodiments, members of the plurality of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the plurality of cells are CD20 positive cells. For certain embodiments, the members of the plurality of cells are physically coupled with a significant amount of extracellular CD20 which (1) have the extracellular part bound by the two or more CD20 binding regions of the multivalent CD20-binding molecule. For certain embodiments, members of the plurality of cells are descendants or members of a B-cell lineage. For certain embodiments, members of the plurality of cells are selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For certain embodiments of the multivalent CD20-binding molecule of the present invention, administration of the multivalent CD20-binding molecule to a CD20-expressing cell, the multivalent CD20-binding molecule is capable of causing death of the cell, i.e. killing the cell. For certain embodiments of the multivalent CD20-binding molecule of the present invention, upon administration of the multivalent CD20-binding molecule to a CD20-expressing cell expressing CD20 having the extracellular part bound by two or more CD20 binding regions of the multivalent CD20-binding molecule, the multivalent CD20-binding molecule is capable of causing death of the cell. For certain further embodiments, the cell express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, the cell is a CD20 positive cell. For certain further embodiments, the cell is physically coupled with a significant amount of extracellular CD20 which (1) have the extracellular part bound by the two or more CD20 binding regions of the multivalent CD20-binding molecule. This cell killing activity may or may not depend on the catalytic activity of one or more Shiga toxin effector regions of the multivalent CD20-binding molecule.

For certain embodiments of the multivalent CD20-binding molecule of the present invention, upon administration of the multivalent CD20-binding molecule to a first population of cells physically coupled to CD20, and a second population of cells, a cytotoxic effect of the multivalent CD20-binding molecule to members of said first population of cells relative to members of said second population of cells is at least 3-fold greater. For certain further embodiments, members of the first population of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the first population of cells are CD20 positive cells. For certain embodiments, the members of the first population of cells are physically coupled with a significant amount of extracellular CD20 which (1) have the extracellular part bound by the two or more CD20 binding regions of the multivalent CD20-binding molecule. For certain embodiments, members of the first population of cells over-express, at a cellular surface, CD20 which have the extracellular part bound by the two or more CD20 binding regions of the multivalent CD20-binding molecule. For certain embodiments, members of the first population of cells over-express CD20 which (1) have the extracellular part bound by the two or more CD20 binding regions of the multivalent CD20-binding molecule, (2) have a transmembrane domain, and (3) remain physically coupled to the cell. For certain embodiments, members of the first population of cells are descendants or members of a B-cell lineage. For certain embodiments, members of the first population of cells are selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell. For certain embodiments, the members of the second population of cells are not physically coupled with extracellular CD20 and/or are CD20 negative. For certain embodiments, the members of the second population of cells are not physically coupled with extracellular CD20 which (I) have the extracellular part bound by the two or more CD20 binding regions of the multivalent CD20-binding molecule. For certain further embodiments, members of the second population of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain embodiments, the members of the second population of cells are not physically coupled with a significant amount of extracellular CD20 which (1) have the extracellular part bound by the two or more CD20 binding regions of the multivalent CD20-binding molecule. For certain embodiments of the multivalent CD20-binding molecule of the present invention, upon administration of the multivalent CD20-binding molecule to a first population of cells whose members are CD20 positive, and a second population of cells whose members are not CD20 positive, a cytotoxic effect of the multivalent CD20-binding molecule to members of said first population of cells relative to members of said second population of cells is at least 3-fold greater.

In certain embodiments, the multivalent CD20-binding molecule of the present invention comprises two or more proteinaceous components (e.g. protein subunits), wherein each proteinaceous component comprises (1) at least one CD20 binding region capable of specifically binding an extracellular part of a CD20 molecule, and, optionally, (2) one or more Shiga toxin effector regions, each comprising a polypeptide derived from the amino acid sequence of the A Subunit of at least one member of the Shiga toxin family. In certain further embodiments, each proteinaceous component comprises (1) only one CD20 binding region capable of specifically binding an extracellular part of a CD20 molecule, and (2) only one Shiga toxin effector region. In certain further embodiments, the multivalent CD20-binding molecule of the present invention comprises exactly two proteinaceous components. In certain embodiments, the multivalent CD20-binding molecule of the present invention comprises two or more components, wherein at least one component is associated with the multivalent CD20-binding molecule through one or more non-covalent interactions. In certain further embodiments, at least one of the components is proteinaceous. In certain further embodiments, the multivalent CD20-binding molecule of the present invention comprises two or more proteinaceous components associated with each other, either directly or indirectly, through one or more non-covalent interactions. In certain further embodiments, each proteinaceous component comprises (1) at least one CD20 binding region capable of specifically binding an extracellular part of a CD20, and (2) a Shiga toxin effector region.

In certain embodiments, the multivalent CD20-binding molecule of the present invention comprises at least one CD20 binding region comprising an immunoglobulin-type binding region. In certain further embodiments, the multivalent CD20-binding molecule of the present invention comprises the CD20 binding region comprising an immunoglobulin-type binding region comprising a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystalline-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality.

In certain embodiments, the multivalent CD20-binding molecule of the present invention does not comprise an immunoglobulin Fc region or Fc region effector which retains an Fc region function, such as, e.g., involving extracellular signaling to immune system factors, cells, and/or tissues. Non-limiting examples of Fc region functions include activating T-cells, stimulating the release of inflammatory mediators such as cytokines like TNF-alpha, initiating complement dependent cytotoxicity (CDC), antibody-dependent cytotoxicity (ADCC), and phagocytosis of the cell bound extracellularly by the molecule comprising the Fc region.

In certain embodiments, the multivalent CD20-binding molecule of the present invention does not comprise any immunoglobulin heavy chain constant region, immunoglobulin light chain constant region, immunoglobulin $C_L$ domain, immunoglobulin $C_H1$ domain, immunoglobulin $C_H2$ domain, and/or immunoglobulin $C_H3$ domain. In certain further embodiments, the multivalent CD20-binding molecule does not comprise any immunoglobulin domains other than the immunoglobulin domains selected from (1) CDR, (2) ABR, and/or (3) any immunoglobulin domain present in an autonomous $V_H$ domain, single-domain antibody domains (sdAb), heavy-chain antibody domain fragment ($V_HH$ fragments or $V_H$ domain fragment), and single-chain variable fragment (scFv). In certain embodiments, the multivalent CD20-binding molecule of the present invention does not comprise any immunoglobulin domain or any polypeptide derived from an immunoglobulin.

In certain embodiments, the multivalent CD20-binding molecule of the present invention comprises at least one Shiga toxin effector region comprising or consisting essentially of the polypeptide selected from the group consisting of: (a) amino acids 75 to 251 of SEQ ID NO: 1, SEQ ID NO:2, or SEQ ID NO:3; (b) amino acids 1 to 241 SEQ ID NO:1, SEQ ID NO:2, or SEQ ID NO:3; (c) amino acids 1 to 251 of SEQ ID NO: 1. SEQ ID NO:2, or SEQ ID NO:3; and (d) amino acids 1 to 261 of SEQ ID NO: 1, SEQ ID NO:2, or SEQ ID NO:3.

In certain embodiments of the multivalent CD20-binding molecule of the present invention, the multivalent CD20-binding molecule is monomeric. In certain other embodiments, the multivalent CD20-binding molecule is multimeric, e.g. the molecule comprises at least two, independent, polypeptide chains (e.g. protein subunits) associated either directly or indirectly to form a single molecule. In certain further embodiments, the multimeric, multivalent CD20-binding molecule of the present invention comprises two or more protein components, e.g., two or more individual CD20-binding proteins. In certain embodiments, the multimeric, multivalent CD20-binding molecule of the present invention comprises two or more protein components (e.g. subunits) which are associated through one or more non-covalent interactions.

In certain embodiments, the multimeric, multivalent CD20-binding molecule of the present invention comprises two or more proteins components (e.g. subunits) which are associated through one or more covalent interactions. In certain further embodiments, the multivalent CD20-binding molecule of the present invention comprises two or more protein components, e.g., two or more individual CD20-binding proteins, which are associated through one or more covalent interactions, wherein at least one covalent interaction is a disulfide bond between at least two of the protein components (e.g., between different protein subunits).

In certain embodiments, the multivalent CD20-binding molecule of the present invention comprises the molecule shown in any one of SEQ ID NOs: 1-304.

In certain embodiments, the multivalent CD20-binding molecule of the present invention comprises a CD20 binding region which comprises the immunoglobulin-type binding region comprising a polypeptide(s) selected from the group consisting of: (a) a heavy chain variable ($V_H$) domain comprising (i) a HCDR1 comprising or consisting essentially of the amino acid sequence as shown in SEQ ID NO:5, SEQ ID NO: 11, SEQ ID NO: 17, SEQ ID NO:23, SEQ ID NO:29, or SEQ ID NO:35; (ii) a HCDR2 comprising or consisting essentially of the amino acid sequence as shown in SEQ ID NO:6. SEQ ID NO: 12, SEQ ID NO: 18, SEQ ID NO:24, SEQ ID NO:30, or SEQ ID NO:36; and/or (iii) a HCDR3 comprising or consisting essentially of the amino acid sequence as shown in SEQ ID NO:7, SEQ ID NO: 13, SEQ ID NO: 19, SEQ ID NO:25, SEQ ID NO:31, or SEQ ID NO:37; and/or (b) a light chain variable ($V_L$) domain comprising (i) a LCDR1 comprising or consisting essentially of the amino acid sequence as shown in SEQ ID NO:8, SEQ ID NO: 14, SEQ ID NO:20, SEQ ID NO:26, SEQ ID NO:32, or SEQ ID NO:38; (ii) a LCDR2 comprising or consisting essentially of the amino acid sequence as shown in SEQ ID NO:9, SEQ ID NO: 15. SEQ ID NO:21, SEQ ID NO:27, SEQ ID NO:33, or SEQ ID NO:39; and/or (iii) a LCDR3 comprising or consisting essentially of the amino acid sequence as shown in SEQ ID NO:10, SEQ ID NO:16, SEQ ID NO:22, SEQ ID NO:28, SEQ ID NO:34, or SEQ ID NO:40.

In certain embodiments, the multivalent CD20-binding molecule of the present invention comprises the CD20 binding region comprising or consisting essentially of amino acids 1-232, 1-233, 1-234, 1-235, 1-236, 1-242, 1-243, 1-244, 1-245, 1-246, 1-252, 1-253, 1-254, 1-255, or 1-256 of any one of SEQ ID NOs: 47-119 and 176-248.

In certain embodiments, the multivalent CD20-binding molecule of the present invention comprises the protein shown in any one of SEQ ID NOs: 47-304, and optionally, the protein further comprises an amino-terminal methionine residue. In certain further embodiments, the multivalent CD20-binding molecule of the present invention comprises or consists essentially of two proteins, each protein selected from any one of the polypeptides shown in SEQ ID NOs: 47-304, and optionally, each protein further comprises an amino-terminal methionine residue. In certain further embodiments, the protein is selected from any one of the proteins shown in SEQ ID NOs: 47-175 and further comprises a disulfide bond involving a cysteine residue at the position selected from the group consisting of: 242, 482, 483, 484, 490, 491, 492, 493, 494, 495, 499, 500, 501, 502, 503, 504, 505, 510, 511, 512, 513, and 521.

For certain embodiments of the multivalent CD20-binding molecule of the present invention, the multivalent CD20-binding molecule is monospecific for CD20-binding. In certain further embodiments, all the CD20 binding regions present in the multivalent CD20-binding molecule bind, on their own, the same extracellular part of the same CD20. In certain further embodiments, all the CD20 binding regions present in the multivalent CD20-binding molecule bind, on their own, the same extracellular CD20 epitope with equivalent specificities.

In certain embodiments, the multivalent CD20-binding molecule of the present invention comprises one or more monovalent CD20-binding molecule components; and whereby upon administration of the multivalent CD20-binding molecule of the present invention to a population of cells physically coupled with CD20, which have the extracellular part bound by two or more CD20 binding regions of the multivalent CD20-binding molecule, the multivalent CD20-binding molecule exhibits a cytotoxic effect to the population of cells which is greater than a cytotoxic effect resulting from administration of an equivalent amount, mass, or molarity of any one of the monovalent CD20-binding molecule components of the multivalent CD20-binding molecule to a population of the same CD20 positive cells under same conditions by a factor of 1.33, 1.5, 1.75, 2, 3, 5, 7.5, 10, 20, 100, or greater than the change in CD20-binding valence between the monovalent CD20-binding component and the multivalent CD20-binding molecule. For certain further embodiments, members of the population of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the population of cells are CD20 positive cells. For certain embodiments, the members of the population of cells are physically coupled with a significant amount of extracellular CD20 which (1) have the extracellular part bound by the two or more CD20 binding regions of the multivalent CD20-binding molecule. For certain embodiments, members of the population of cells are descendants or members of a B-cell lineage. For certain embodiments, members of the population of cells are selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell. In certain embodiments, the multivalent CD20-binding molecule of the present invention comprises one or more monovalent CD20-binding molecule components; and whereby upon administration of the multivalent CD20-binding molecule of the present invention to a population of CD20 positive cells expressing CD20 which have the extracellular part bound by two or more CD20 binding regions of the multivalent CD20-binding molecule, the multivalent CD20-binding molecule exhibits a cytotoxic effect which is greater than a cytotoxic effect resulting from administration of an equivalent amount, mass, or molarity of any one of the monovalent CD20-binding molecule components of the multivalent CD20-binding molecule to a population of the same CD20 positive cells under same conditions by a factor of 1.33, 1.5, 1.75, 2, 3, 5, 7.5, 10, 20, 100, or greater than the change in CD20-binding valence between the monovalent CD20-binding component and the multivalent CD20-binding molecule.

In certain embodiments, the multivalent CD20-binding molecule of the present invention comprises one or more monovalent CD20-binding molecule components; and whereby upon administration of the multivalent CD20-binding molecule of the present invention to a population of cells physically coupled with CD20, which have the extracellular part bound by two or more CD20 binding regions of the multivalent CD20-binding molecule, the multivalent CD20-binding molecule exhibits a cytotoxic effect which is greater than a cytotoxic effect resulting from administration of an equivalent amount, mass, or molarity of any one of the monovalent CD20-binding molecule components of the multivalent CD20-binding molecule to a population of the same CD20 positive cells under same conditions by a factor of 1.33, 1.5, 1.75, 2, 3, 5, 7.5, 10, 20, 100, or greater than the change in equilibrium binding constants ($K_D$) between the multivalent CD20-binding molecule and the monovalent CD20-binding component for binding to CD20 or CD20-expressing cell. For certain further embodiments, members of the population of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the population of cells are CD20 positive cells. For certain embodiments, the members of the population of cells are physically coupled with a significant amount of extracellular CD20 which (1) have the extracellular part bound by the two or more CD20 binding regions of the multivalent CD20-binding molecule. For certain embodiments, members of the population of cells are descendants or members of a B-cell lineage. For certain embodiments, members of the population of cells are selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell. B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell. T-cell lymphoma cell, T-cell large granular lymphocyte leukemia cell, T-cell prolymphocytic leukemia, healthy B-cell lineage cell, and/or healthy T-cell. In certain embodiments, the multivalent CD20-binding molecule of the present invention comprises one or more monovalent CD20-binding molecule components; and whereby upon administration of the multivalent CD20-binding molecule of the present invention to a population of CD20 positive cells expressing CD20 which have the extracellular part bound by two or more CD20 binding regions of the multivalent CD20-binding molecule, the multivalent CD20-binding molecule exhibits a cytotoxic effect which is greater than a cytotoxic effect resulting from administration of an equivalent amount, mass, or molarity of any one of the monovalent CD20-binding molecule components of the multivalent CD20-binding molecule to a population of the same CD20 positive cells under same conditions by a factor of 1.33, 1.5, 1.75, 2, 3, 5, 7.5, 10, 20, 100, or greater than the change in equilibrium binding constants ($K_D$) between the multivalent CD20-binding molecule and the monovalent CD20-binding component for binding to CD20 or CD20-expressing cell.

In certain embodiments, the multivalent CD20-binding molecule of the present invention comprises one or more monovalent CD20-binding molecule components; and whereby upon administration of the multivalent CD20-binding molecule of the present invention to a population of cells physically coupled with CD20, which have the extracellular part bound by two or more CD20 binding regions of the multivalent CD20-binding molecule, the multivalent CD20-binding molecule exhibits a cytotoxic effect which is greater than a cytotoxic effect resulting from administration of an equivalent amount, mass, or molarity of any one of the monovalent CD20-binding molecule components of the multivalent CD20-binding molecule to a population of the same CD20 positive cells under same conditions by a factor of 1.33, 1.5, 1.75, 2, 3, 5, 7.5, 10, 20, 100, or greater than the change in affinity constant ($1/K_D$) between the multivalent CD20-binding molecule and the monovalent CD20-binding component for binding to CD20 or CD20-expressing cell. For certain further embodiments, members of the population of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the population of cells are CD20 positive cells. For certain embodiments, the members of the population of cells are physically coupled with a significant amount of extracellular CD20 which (1) have the extracellular part bound by the two or more CD20 binding regions of the multivalent CD20-binding molecule. For certain embodiments, members of the population of cells are descendants or members of a B-cell lineage. For certain embodiments, members of the population of cells are selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell. Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell. In certain embodiments, the multivalent CD20-binding molecule of the present invention comprises one or more monovalent CD20-binding molecule components; and whereby upon administration of the multivalent CD20-binding molecule of the present invention to a population of CD20 positive cells expressing CD20 which have the extracellular part bound by two or more CD20 binding regions of the multivalent CD20-binding molecule, the multivalent CD20-binding molecule exhibits a cytotoxic effect which is greater than a cytotoxic effect resulting from administration of an equivalent amount, mass, or molarity of any one of the monovalent CD20-binding molecule components of the multivalent CD20-binding molecule to a population of the same CD20 positive cells under same conditions by a factor of 1.33, 1.5, 1.75, 2, 3, 5, 7.5, 10, 20, 100, or greater than the change in affinity constant ($1/K_D$) between the multivalent CD20-binding molecule and the monovalent CD20-binding component for binding to CD20 or CD20-expressing cell.

In certain embodiments of the multivalent CD20-binding molecule of the present invention, one or more polypeptide components of the CD20-binding molecule comprises a carboxy-terminal endoplasmic reticulum retention/retrieval signal motif of a member of the KDEL family. In certain further embodiments, the carboxy-terminal endoplasmic reticulum retention/retrieval signal motif is selected from the group consisting of: KDEL (SEQ ID NO:305), HDEF (SEQ ID NO:306), HDEL (SEQ ID NO:307), RDEF (SEQ ID NO:308), RDEL (SEQ ID NO:309), WDEL (SEQ ID NO:310), YDEL (SEQ ID NO:311), HEEF (SEQ ID NO:312), HEEL (SEQ ID NO:313). KEEL (SEQ ID NO:314), REEL (SEQ ID NO:315), KAEL (SEQ ID NO:316), KCEL (SEQ ID NO:317), KFEL (SEQ ID NO:318), KGEL (SEQ ID NO:319), KHEL (SEQ ID NO:320), KLEL (SEQ ID NO:321), KNEL (SEQ ID NO:322), KQEL (SEQ ID NO:323), KREL (SEQ ID NO:324), KSEL (SEQ ID NO:325), KVEL (SEQ ID NO:326), KWEL (SEQ ID NO:327), KYEL (SEQ ID NO:328), KEDL (SEQ ID NO:329), KIEL (SEQ ID NO:330), DKEL (SEQ ID NO:331), FDEL (SEQ ID NO:332), KDEF (SEQ ID NO:333), KKEL (SEQ ID NO:334), HADL (SEQ ID NO:335), HAEL (SEQ ID NO:336), HIEL (SEQ ID NO:337), HNEL (SEQ ID NO:338), HTEL (SEQ ID NO:339), KTEL (SEQ ID NO:340), HVEL (SEQ ID NO:341), NDEL (SEQ ID NO:342), QDEL (SEQ ID NO:343). REDL (SEQ ID NO:344), RNEL (SEQ ID NO:345), RTDL (SEQ ID NO:346), RTEL (SEQ ID NO:347), SDEL (SEQ ID NO:348), TDEL (SEQ ID NO:349), SKEL (SEQ ID NO:350), STEL (SEQ ID NO:351), and EDEL (SEQ ID NO:352).

In certain embodiments of the multivalent CD20-binding molecule of the present invention, one or more Shiga toxin effector regions comprises a mutation relative to a naturally occurring A Subunit of a member of the Shiga toxin family that changes the enzymatic activity of the Shiga toxin effector region, the mutation selected from at least one amino acid residue deletion, insertion, or substitution, such as, e.g., A231E, R75A, Y77S, Y114S, E167D, R170A, R176K and/or W203A in SEQ ID NO: 1, SEQ ID NO:2, SEQ ID NO:3, or SEQ ID NO:4. In certain further embodiments, the mutation is selected from at least one amino acid residue deletion, insertion, or substitution that reduces or eliminates catalytic activity but retains at least one other Shiga toxin effector function, such as, e.g., inducing cellular internalization and/or directing subcellular routing. In certain further embodiments, the mutation reduces or eliminates cytotoxicity of the Shiga toxin effecter region.

For certain embodiments of the multivalent CD20-binding molecule, the multivalent CD20-binding molecule may be utilized for the delivery of additional exogenous material into a cell. In certain embodiments, the multivalent CD20-binding molecule of the present invention comprises an additional exogenous material. For certain embodiments of the multivalent CD20-binding molecule of the present invention, which comprises an additional exogenous material; whereby upon administration of the multivalent CD20-binding molecule to one or more cells physically coupled with CD20, which have the extracellular part bound by the two or more CD20 binding regions of the multivalent CD20-binding molecule, the multivalent CD20-binding molecule internalizes into the one or more cells in about five hours, four hours, three hours, two hours, one hour, thirty minutes, or less at a physiological temperature appropriate for the cell and/or at about 37 degrees Celsius. For certain further embodiments, the one or more cell(s) expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, one or more cell(s) is a CD20 positive cell. For certain embodiments, one or more cell(s) is physically coupled with a significant amount of extracellular CD20 which (1) have the extracellular part bound by the two or more CD20 binding regions of the multivalent CD20-binding molecule. For certain embodiments, one or more cell(s) is a descendant or member of a B-cell lineage. For certain embodiments, one or more cell(s) is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For certain embodiments of the multivalent CD20-binding molecule of the present invention, which comprises an additional exogenous material; whereby upon administration of the multivalent CD20-binding molecule to one or more cells physically coupled with CD20, which have the extracellular part bound by the two or more CD20 binding regions of the multivalent CD20-binding molecule, the multivalent CD20-binding molecule internalizes into the one or more cells and delivers the additional exogenous material into the interior of the cell in about five hours, four hours, three hours, two hours, one hour, thirty minutes, or less at a physiological temperature appropriate for the cell and/or at about 37 degrees Celsius. For certain further embodiments, the one or more cell(s) expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, one or more cell(s) is a CD20 positive cell. For certain embodiments, one or more cell(s) is physically coupled with a significant amount of extracellular CD20 which (1) have the extracellular part bound by the two or more CD20 binding regions of the multivalent CD20-binding molecule. For certain embodiments, one or more cell(s) is a descendant or member of a B-cell lineage. For certain embodiments, one or more cell(s) is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell. Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell. T-cell large granular lymphocyte leukemia cell, T-cell prolymphocytic leukemia, healthy B-cell lineage cell, and/or healthy T-cell.

For certain embodiments of the multivalent CD20-binding molecule of the present invention, which comprises an additional exogenous material; whereby upon administration of the multivalent CD20-binding molecule to a plurality of cells physically coupled with CD20, which have the extracellular part bound by the two or more CD20 binding regions of the multivalent CD20-binding molecule, at a concentration of multivalent CD20-binding molecule equivalent to five or thirty-eight percent to fifty percent cell-surface occupancy, the majority of the multivalent CD20-binding molecule internalizes into the plurality of cells in about five hours, four hours, three hours, two hours, one hour, thirty minutes, or less at a physiological temperature appropriate for the cell and/or at about 37 degrees Celsius. For certain further embodiments, members of the plurality of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the plurality of cells are CD20 positive cells. For certain embodiments, the members of the plurality of cells are physically coupled with a significant amount of extracellular CD20 which (1) have the extracellular part bound by the two or more CD20 binding regions of the multivalent CD20-binding molecule. For certain embodiments, members of the plurality of cells are descendants or members of a B-cell lineage. For certain embodiments, members of the plurality of cells are selected from the group consisting of: malignant B-cell, B-cell leukemia cell, B-cell lymphoma cell, B-cell myeloma cell, acute myeloid leukemia cell, acute non-lymphocytic leukemia cell. B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For certain embodiments of the multivalent CD20-binding molecule of the present invention, which comprises an additional exogenous material; whereby upon administration of the multivalent CD20-binding molecule to one or more cells physically coupled with CD20, which have the extracellular part bound by the two or more CD20 binding regions of the multivalent CD20-binding molecule, the multivalent CD20-binding molecule internalizes into the one or more cells and delivers the additional exogenous material into the interior of the cell in about five hours, four hours, three hours, two hours, one hour, thirty minutes, or less at a physiological temperature appropriate for the cell and/or at about 37 degrees Celsius. For certain further embodiments, the one or more cell(s) expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, one or more cell(s) is a CD20 positive cell. For certain embodiments, one or more cell(s) is physically coupled with a significant amount of extracellular CD20 which (1) have the extracellular part bound by the two or more CD20 binding regions of the multivalent CD20-binding molecule. For certain embodiments, one or more cell(s) is a descendant or member of a B-cell lineage. For certain embodiments, one or more cell(s) is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell. Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell. T-cell large granular lymphocyte leukemia cell, T-cell prolymphocytic leukemia, healthy B-cell lineage cell, and/or healthy T-cell.

For certain embodiments of the multivalent CD20-binding molecule of the present invention, which comprises an additional exogenous material; whereby upon administration of the multivalent CD20-binding molecule to a plurality of cells physically coupled with CD20, which have the extracellular part bound by the two or more CD20 binding regions of the multivalent CD20-binding molecule, at a concentration of multivalent CD20-binding molecule equivalent to five or thirty-eight percent to fifty percent cell-surface occupancy, the majority of the multivalent CD20-binding molecule internalizes into the plurality of cells and delivers the additional exogenous material into the interiors of the cells in about five hours, four hours, three hours, two hours, one hour, thirty minutes, or less at a physiological temperature appropriate for the cell and/or at about 37 degrees Celsius. For certain further embodiments, members of the plurality of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the plurality of cells are CD20 positive cells. For certain embodiments, the members of the plurality of cells are physically coupled with a significant amount of extracellular CD20 which (1) have the extracellular part bound by the two or more CD20 binding regions of the multivalent CD20-binding molecule. For certain embodiments, members of the plurality of cells are descendants or members of a B-cell lineage. For certain embodiments, members of the plurality of cells are selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

The embodiments of the multivalent CD20-binding molecules of the present invention for the delivery of additional exogenous material into a cell each comprise (1) two or more CD20 binding regions, each capable of specifically binding an extracellular part of a CD20 and (2) an additional exogenous material. In certain embodiments, the multivalent CD20-binding molecule of the present invention comprises an additional exogenous material selected from the group consisting of: cytotoxic agent, detection promoting agent, peptide, polypeptide, protein, and polynucleotide. In certain further embodiments, the additional exogenous material is the protein comprising an enzyme. In certain other embodiments, the additional exogenous material is the polynucleotide which functions as a small inhibiting RNA (siRNA) or microRNA (miRNA). In certain embodiments, the additional exogenous material is the peptide which is an antigen, such as, e.g., from a pathogen. In certain embodiments, the antigen comprises or consists essentially of SEQ ID NO:46. In certain embodiments, the antigen is derived from a molecule selected from the group consisting of: bacterial protein, protein mutated in cancer, protein aberrantly expressed in cancer, T-cell complementary determining region polypeptide, and/or viral protein. In certain embodiments, the cytotoxic agent is a chemotherapeutic agent, cytotoxic antibiotic, alkylating agent, antimetabolite, topoisomerase inhibitor, and/or tubulin inhibitor.

The present invention also provides compositions comprising a multivalent CD20-binding molecule (multivalent CD20-binding molecule compositions) of the present invention, such as, e.g., compositions enriched for a multivalent CD20-binding molecule of the present invention and/or compositions with relatively large proportions of multivalent CD20-binding molecule relative to monovalent CD20-binding molecules. In certain embodiments, the multivalent CD20-binding molecule composition of the present invention comprises a multivalent CD20-binding molecule of the present invention, wherein the composition comprises a ratio of monovalent CD20-binding molecule concentration to total CD20-binding molecule concentration of less than one to three; and wherein each monovalent CD20-binding molecule comprises only one CD20 binding region capable of specifically binding an extracellular part of a CD20 and comprises at least one Shiga toxin effector polypeptide. In certain further embodiments, the multivalent CD20-binding molecule composition comprises the ratio of monovalent CD20-binding molecule concentration to total CD20-binding protein concentration of less than the ratio selected from the following: 1:5, 1:6, 1:7, 1:8, 1:9, 1:10, and 1:11. In certain embodiments, the multivalent CD20-binding molecule composition of the present invention comprises a ratio of multivalent CD20-binding molecule concentration to total CD20-binding molecule concentration of more than two to three.

In certain embodiments, the multivalent CD20-binding molecule composition of the present invention comprises a ratio of relatively large valence, CD20-binding molecule concentration to total CD20-binding molecule concentration of less than the ratio selected from the following: 1:4, 1:7, 1:11, 1:21, 1:41, 1:71, 1:111, and 1:161; wherein each relatively large valence, CD20-binding molecule comprises three or more CD20 binding regions capable of specifically binding an extracellular part of a CD20 and comprises at least one Shiga toxin effector polypeptide.

In certain embodiments, the multivalent CD20-binding molecule composition of the present invention comprises a ratio of bivalent CD20-binding molecule concentration to total CD20-binding molecule concentration of more than a ratio selected from the following: 1:2, 2:3, 3:4, 4:5, 5:6, 7:8, 8:9, 9:10, 10:11, 11:12, 12:13, 13:14, and 14:15; wherein each bivalent CD20-binding molecule comprises (1) only two CD20 binding regions capable of specifically binding an extracellular part of a CD20 and (2) one or more Shiga toxin effector polypeptides.

For certain embodiments of the multivalent CD20-binding molecule composition of the present invention, upon administration of the multivalent CD20-binding molecule composition to a first population of cells physically coupled to CD20, and a second population of cells, a cytotoxic effect of the multivalent CD20-binding molecule composition to members of said first population of cells relative to members of said second population of cells is at least 3-fold greater. For certain further embodiments, members of the first population of cells express at a cellular surface the CD20 which (1) have the extracellular part bound by the two or more CD20 binding regions of a multivalent CD20-binding molecule of the multivalent CD20-binding molecule composition, (2) have a transmembrane domain, and (3) remain physically coupled to the cell. For certain further embodiments, members of the first population of cells are CD20 positive cells. For certain embodiments, the members of the first population of cells are physically coupled with a significant amount of extracellular CD20 which (1) have the extracellular part bound by the two or more CD20 binding regions of a multivalent CD20-binding molecule of the multivalent CD20-binding molecule composition. For certain embodiments, members of the first population of cells over-express, at a cellular surface, CD20 which have the extracellular part bound by the two or more CD20 binding regions of a multivalent CD20-binding molecule of the multivalent CD20-binding molecule composition. For certain embodiments, members of the first population of cells over-express CD20 which (1) have the extracellular part bound by the two or more CD20 binding regions of a multivalent CD20-binding molecule of the multivalent CD20-binding molecule composition, (2) have a transmembrane domain, and (3) remain physically coupled to the cell. For certain embodiments, members of the first population of cells are descendants or members of a B-cell lineage. For certain embodiments, members of the first population of cells are selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell. For certain embodiments, the members of the second population of cells are not physically coupled with extracellular CD20 and/or are CD20 negative. For certain embodiments, the members of the second population of cells are not physically coupled with extracellular CD20 which (1) have the extracellular part bound by the two or more CD20 binding regions of the multivalent CD20-binding molecule. For certain further embodiments, members of the second population of cells express at a cellular surface the CD20 which (1) have the extracellular part bound by the two or more CD20 binding regions of a multivalent CD20-binding molecule of the multivalent CD20-binding molecule composition, (2) have a transmembrane domain, and (3) remain physically coupled to the cell. For certain embodiments, the members of the second population of cells are not physically coupled with a significant amount of extracellular CD20 which (1) have the extracellular part bound by the two or more CD20 binding regions of any multivalent CD20-binding molecule of the multivalent CD20-binding molecule composition. For certain embodiments of the multivalent CD20-binding molecule composition of the present invention, upon administration of the multivalent CD20-binding molecule composition to a first population of cells whose members are CD20 positive, and a second population of cells whose members are not CD20 positive, a cytotoxic effect of the multivalent CD20-binding molecule composition to members of said first population of cells relative to members of said second population of cells is at least 3-fold greater.

In certain embodiments, the multivalent CD20-binding molecule composition of the present invention comprises a multivalent CD20-binding molecule having one or more monovalent CD20-binding molecule components; and whereby upon administration of the multivalent CD20-binding molecule composition of the present invention to a population of cells physically coupled with CD20, which have the extracellular part bound by two or more CD20 binding regions of the multivalent CD20-binding molecule, the multivalent CD20-binding molecule composition exhibits a cytotoxic effect which is greater than a cytotoxic effect resulting from administration of an equivalent amount, mass, or molarity of any one of the monovalent CD20-binding molecule components to a population of the same CD20 positive cells under same conditions by a factor of 1.33, 1.5, 1.75, 2, 3, 5, 7.5, 10, 20, 100, or greater than the change in CD20-binding valence between the monovalent CD20-binding component and the multivalent CD20-binding molecule. For certain further embodiments, members of the population of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the population of cells are CD20 positive cells. For certain embodiments, the members of the population of cells are physically coupled with a significant amount of extracellular CD20 which (1) have the extracellular part bound by the two or more CD20 binding regions of the multivalent CD20-binding molecule. For certain embodiments, members of the population of cells are descendants or members of a B-cell lineage. For certain embodiments, members of the population of cells are selected from the group consisting of: malignant B-cell. B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell. B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell. Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell. In certain embodiments, the multivalent CD20-binding molecule composition of the present invention comprises a multivalent CD20-binding molecule having one or more monovalent CD20-binding molecule components; and whereby upon administration of the multivalent CD20-binding molecule composition of the present invention to a population of CD20 positive cells expressing CD20 which have the extracellular part bound by two or more CD20 binding regions of the multivalent CD20-binding molecule, the multivalent CD20-binding molecule composition exhibits a cytotoxic effect which is greater than a cytotoxic effect resulting from administration of an equivalent amount, mass, or molarity of any one of the monovalent CD20-binding molecule components to a population of the same CD20 positive cells under same conditions by a factor of 1.33, 1.5, 1.75, 2, 3, 5, 7.5, 10, 20, 100, or greater than the change in CD20-binding valence between the monovalent CD20-binding component and the multivalent CD20-binding molecule.

For certain embodiments of the multivalent CD20-binding molecule composition of the present invention, which comprises a multivalent CD20-binding molecule having an additional exogenous material; whereby upon administration of the multivalent CD20-binding molecule composition to a plurality of cells physically coupled with CD20, which have the extracellular part bound by the two or more CD20 binding regions of the multivalent CD20-binding molecule, at a concentration of multivalent CD20-binding molecule equivalent to five or thirty-eight percent to fifty percent cell-surface occupancy, the majority of the multivalent CD20-binding molecule internalizes into the plurality of cells in about five hours, four hours, three hours, two hours, one hour, thirty minutes, or less at a physiological temperature appropriate for the cell and/or at about 37 degrees Celsius. For certain further embodiments, members of the plurality of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the plurality of cells are CD20 positive cells. For certain embodiments, the members of the plurality of cells are physically coupled with a significant amount of extracellular CD20 which (1) have the extracellular part bound by the two or more CD20 binding regions of the multivalent CD20-binding molecule. For certain embodiments, members of the plurality of cells are descendants or members of a B-cell lineage. For certain embodiments, members of the plurality of cells are selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell. B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For certain embodiments of the multivalent CD20-binding molecule composition of the present invention, which comprises a multivalent CD20-binding molecule having an additional exogenous material; whereby upon administration of the multivalent CD20-binding molecule composition to one or more cells physically coupled with CD20, which have the extracellular part bound by the two or more CD20 binding regions of the multivalent CD20-binding molecule, the multivalent CD20-binding molecule internalizes into the one or more cells and delivers the additional exogenous material into the interior of the cell in about five hours, four hours, three hours, two hours, one hour, thirty minutes, or less at a physiological temperature appropriate for the cell and/or at about 37 degrees Celsius. For certain further embodiments, the one or more cell(s) expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, one or more cell(s) is a CD20 positive cell. For certain embodiments, one or more cell(s) is physically coupled with a significant amount of extracellular CD20 which (1) have the extracellular part bound by the two or more CD20 binding regions of the multivalent CD20-binding molecule. For certain embodiments, one or more cell(s) is a descendant or member of a B-cell lineage. For certain embodiments, one or more cell(s) is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For certain embodiments of the multivalent CD20-binding molecule composition of the present invention, which comprises a multivalent CD20-binding molecule having an additional exogenous material; whereby upon administration of the multivalent CD20-binding molecule composition to a plurality of cells physically coupled with CD20, which have the extracellular part bound by the two or more CD20 binding regions of the multivalent CD20-binding molecule, at a concentration of multivalent CD20-binding molecule equivalent to five or thirty-eight percent to fifty percent cell-surface occupancy, the majority of the multivalent CD20-binding molecule internalizes into the plurality of cells and delivers the additional exogenous material into the interiors of the cells in about five hours, four hours, three hours, two hours, one hour, thirty minutes, or less at a physiological temperature appropriate for the cell and/or at about 37 degrees Celsius. For certain further embodiments, members of the plurality of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the plurality of cells are CD20 positive cells. For certain embodiments, the members of the plurality of cells are physically coupled with a significant amount of extracellular CD20 which (1) have the extracellular part bound by the two or more CD20 binding regions of the multivalent CD20-binding molecule. For certain embodiments, members of the plurality of cells are descendants or members of a B-cell lineage. For certain embodiments, members of the plurality of cells are selected from the group consisting of: malignant B-cell. B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

The present invention also provides pharmaceutical compositions comprising a multivalent CD20-binding molecule of the present invention and/or a multivalent CD20-binding molecule of the present invention, and comprising at least one pharmaceutically acceptable excipient or carrier; and the use of such a multivalent CD20-binding molecule or a composition comprising it in making such pharmaceutical compositions and in methods of the present invention as further described herein. Certain embodiments of the present invention are pharmaceutical compositions comprising any multivalent CD20 binding molecule of the present invention (e.g. a multivalent CD20-binding protein of the present invention) and at least one pharmaceutically acceptable excipient or carrier.

Among certain embodiments of the present invention is a diagnostic composition comprising a multivalent CD20-binding molecule of the present invention that further comprises a detection promoting agent for the collection of information about a cell, cell type, tissue, organ, disease, disorder, condition, subject, and/or patient.

Beyond the multivalent CD20-binding molecules of the present invention, and compositions thereof, polynucleotides capable of encoding a multivalent CD20-binding molecule of the present invention (e.g. a multivalent CD20-binding protein), or polypeptide component thereof, are within the scope of the present invention, as well as expression vectors which comprise a polynucleotide of the invention and host cells comprising an expression vector of the present invention. Host cells comprising an expression vector of the present invention may be used. e.g., in methods for producing a multivalent CD20-binding molecule of the present invention or a polypeptide component or fragment thereof by recombinant expression. Similarly, host cells comprising an expression vector of the present invention may be used, e.g., in methods for producing a multivalent CD20-binding molecule composition of the present invention, or a polypeptide component thereof.

The present invention also encompasses any composition of matter of the present invention which is immobilized on a solid substrate. Such arrangements of the compositions of matter of the present invention may be utilized, e.g., in methods of screening molecules as described herein.

Additionally, the present invention provides methods of killing cell(s) comprising the step of contacting a cell(s) with a multivalent CD20-binding molecule of the present invention, a multivalent CD20-binding molecule composition of the present invention, and/or a pharmaceutical composition of the present invention. For certain embodiments, the step of contacting the cell(s) occurs in vitro. For certain other embodiments, the step of contacting the cell(s) occurs in vivo. For certain embodiments of the cell-killing methods of the present invention, the method is capable of selectively killing cell(s) and/or cell types preferentially over other cell(s) and/or cell types when contacting a mixture of cells comprising different cells which differ with respect to the cell-surface presence and/or expression level of a CD20 bound by the two or more CD20 binding regions of the multivalent CD20-binding molecule and/or the multivalent CD20-binding molecule of the composition of the present invention (e.g., a multivalent CD20-binding molecule composition and/or a pharmaceutical composition of the present invention).

In addition, the present invention provides a method of inducing cellular internalization of a multivalent CD20-binding molecule into a cell(s) physically coupled with CD20, which have the extracellular part bound by two or more CD20 binding regions of the multivalent CD20-binding molecule, the method comprising the step of contacting the cell(s) with a multivalent CD20-binding molecule of the present invention, a multivalent CD20-binding molecule composition of the present invention, a pharmaceutical composition of the present invention, and/or a diagnostic composition of the present invention. For certain further embodiments of the inducing cellular internalization method, the step of contacting the cell(s) occurs in vitro. For certain other embodiments, the step of contacting the cell(s) occurs in vivo, such as, e.g., within a patient. For certain further embodiments of the inducing cellular internalization method, the cellular internalization of the multivalent CD20-binding molecule occurs in about five hours, four hours, three hours, two hours, one hour, thirty minutes, or less at a physiological temperature appropriate for the cell and/or at about 37 degrees Celsius. For certain further embodiments, the cell expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, the cell is a CD20 positive cell. For certain embodiments, the cell is physically coupled with a significant amount of extracellular CD20 which (1) have the extracellular part bound by the two or more CD20 binding regions of the multivalent CD20-binding molecule. For certain embodiments, the cell is a descendent or member of a B-cell lineage. For certain embodiments, the cell is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For certain embodiments, the present invention provides a method of inducing cellular internalization of a multivalent CD20-binding molecule into a plurality of cells physically coupled with CD20, which have the extracellular part bound by two or more CD20 binding regions of the multivalent CD20-binding molecule, the method comprising the step of contacting the plurality of cells with a multivalent CD20-binding molecule of the present invention, a multivalent CD20-binding molecule composition of the present invention, a pharmaceutical composition of the present invention, and/or a diagnostic composition of the present invention. For certain further embodiments of the inducing cellular internalization method, the step of contacting the cell(s) occurs in vitro. For certain other embodiments, the step of contacting the cell(s) occurs in vivo, such as, e.g., within a patient. For certain further embodiments of the inducing cellular internalization method, the cellular internalization of the multivalent CD20-binding molecule occurs in about five hours, four hours, three hours, two hours, one hour, thirty minutes, or less at a physiological temperature appropriate for the cell and/or at about 37 degrees Celsius. For certain further embodiments, members of the plurality of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the plurality of cells are CD20 positive cells. For certain embodiments, the members of the plurality of cells are physically coupled with a significant amount of extracellular CD20 which (1) have the extracellular part bound by the two or more CD20 binding regions of the multivalent CD20-binding molecule. For certain embodiments, members of the plurality of cells are descendants or members of a B-cell lineage. For certain embodiments, members of the plurality of cells are selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell. B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

Similarly, the present invention provides a method of internalizing a cell surface localized CD20 bound by a multivalent CD20-binding molecule of the present invention, the method comprising the step of contacting a cell(s) having cell surface localized CD20, which have the extracellular part bound by two or more CD20 binding regions of the multivalent CD20-binding molecule, with a multivalent CD20-binding molecule of the present invention, a multivalent CD20-binding molecule composition of the present invention, pharmaceutical composition of the present invention, and/or a diagnostic composition of the present invention. For certain further embodiments of the method of internalizing cell surface localized CD20, the step of contacting the cell(s) occurs in vitro. For certain other embodiments, the step of contacting the cell(s) occurs in vivo, such as, e.g., within a patient. For certain further embodiments of the of the method of internalizing cell surface localized CD20, the internalization of cell surface localized CD20 occurs in about five hours, four hours, three hours, two hours, one hour, thirty minutes, or less at a physiological temperature appropriate for the cell and/or at about 37 degrees Celsius. For certain further embodiments, the cell expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, the cell is a CD20 positive cell. For certain embodiments, the cell is physically coupled with a significant amount of extracellular CD20 which (1) have the extracellular part bound by the two or more CD20 binding regions of the multivalent CD20-binding molecule. For certain embodiments, the cell is a descendant or member of a B-cell lineage. For certain embodiments, the cell is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell. T-cell prolymphocytic leukemia, healthy B-cell lineage cell, and/or healthy T-cell.

For certain embodiments, the present invention provides a method of internalizing a cell surface localized CD20 bound by a multivalent CD20-binding molecule of the present invention, the method comprising the step of contacting a plurality of cells having cell surface localized CD20, which have the extracellular part bound by two or more CD20 binding regions of the multivalent CD20-binding molecule, with a multivalent CD20-binding molecule of the present invention, a multivalent CD20-binding molecule composition of the present invention, pharmaceutical composition of the present invention, and/or a diagnostic composition of the present invention. For certain further embodiments of the method of internalizing cell surface localized CD20, the step of contacting the plurality of cells occurs in vitro. For certain other embodiments, the step of contacting the plurality of cells occurs in vivo, such as, e.g., within a patient. For certain further embodiments of the of the method of internalizing cell surface localized CD20, the internalization of cell surface localized CD20 occurs in a majority of the cells of the plurality of cells in about five hours, four hours, three hours, two hours, one hour, thirty minutes, or less at a physiological temperature appropriate for the cell and/or at about 37 degrees Celsius. For certain further embodiments, members of the plurality of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the plurality of cells are CD20 positive cells. For certain embodiments, the members of the plurality of cells are physically coupled with a significant amount of extracellular CD20 which (1) have the extracellular part bound by the two or more CD20 binding regions of the multivalent CD20-binding molecule. For certain embodiments, members of the plurality of cells are descendants or members of a B-cell lineage. For certain embodiments, members of the plurality of cells are selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell. T-cell large granular lymphocyte leukemia cell, T-cell prolymphocytic leukemia, healthy B-cell lineage cell, and/or healthy T-cell.

For certain embodiments, the present invention provides a method of inducing cellular internalization of a cell surface localized CD20 bound by a multivalent CD20-binding molecule in a subject, the method comprising the step of administering to the subject a multivalent CD20-binding molecule of the present invention, a multivalent CD20-binding molecule composition of the present invention, pharmaceutical composition of the present invention, and/or a diagnostic composition of the present invention.

Additionally, the present invention provides a method for delivering an exogenous material to the inside of a cell, the method comprising the step of contacting the cell(s), either in vitro or in vivo, with a multivalent CD20-binding molecule of the present invention which comprises an additional exogenous material, a multivalent CD20-binding molecule composition of the present invention comprising a multivalent CD20-binding molecule of the present invention which comprises an additional exogenous material, a pharmaceutical composition of the present invention comprising a multivalent CD20-binding molecule of the present invention which comprises an additional exogenous material, and/or a diagnostic composition of the present invention comprising a multivalent CD20-binding molecule of the present invention which comprises an additional exogenous material. For certain further embodiments, the cell is physically coupled with CD20 which have the extracellular part bound by two or more CD20 binding regions of the multivalent CD20-binding molecule. For certain further embodiments, the cell expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, the cell is a CD20 positive cell. For certain embodiments, the cell is physically coupled with a significant amount of extracellular CD20 which (1) have the extracellular part bound by the two or more CD20 binding regions of the multivalent CD20-binding molecule. For certain embodiments, the cell is a descendant or member of a B-cell lineage. For certain embodiments, the cell is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For certain embodiments, the present invention provides a method of delivering an exogenous material to the inside of a cell, the method comprising the step of administering to a subject a multivalent CD20-binding molecule of the present invention which comprises an additional exogenous material, a multivalent CD20-binding molecule composition of the present invention comprising a multivalent CD20-binding molecule of the present invention which comprises an additional exogenous material, a pharmaceutical composition of the present invention comprising a multivalent CD20-binding molecule of the present invention which comprises an additional exogenous material, and/or a diagnostic composition of the present invention comprising a multivalent CD20-binding molecule of the present invention which comprises an additional exogenous material. For certain further embodiments, the cell is physically coupled with CD20 which have the extracellular part bound by two or more CD20 binding regions of the multivalent CD20-binding molecule. For certain further embodiments, the cell expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, the cell is a CD20 positive cell. For certain embodiments, the cell is physically coupled with a significant amount of extracellular CD20 which (1) have the extracellular part bound by the two or more CD20 binding regions of the multivalent CD20-binding molecule. For certain embodiments, the cell is a descendant or member of a B-cell lineage. For certain embodiments, the cell is selected from the group consisting of: malignant B-cell, B-cell leukemia cell, B-cell lymphoma cell. B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For certain further embodiments, the cell, cells, and population of cells referred to as (1) "cell"; (2) "cell physically coupled with CD20"; (3) "cell expressing, at a cellular surface, CD20"; (4) "CD20 positive cell"; (5) "plurality of cells"; (6) "plurality of cells physically coupled with CD20"; (7) "population of cells"; (8) "population of CD20 positive cells"; or (9) "one or more cells" are a cell, cells, or population of cells that (a) is physically coupled with extracellular CD20; (b) expresses at a cellular surface the CD20 which (i) have the extracellular part bound by the two or more CD20 binding regions of the multivalent CD20-binding molecule, (ii) have a transmembrane domain, and (iii) remain physically coupled to the cell(s); (c) is a CD20 positive; (d) is physically coupled with a significant amount of extracellular CD20 which have the extracellular part bound by the two or more CD20 binding regions of the multivalent CD20-binding molecule; (e) is a descendant or member of a B-cell lineage; and/or (f) is one or more of the following: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell. Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell. T-cell large granular lymphocyte leukemia cell, T-cell prolymphocytic leukemia, healthy B-cell lineage cell, and/or healthy T-cell.

The use of any composition of the present invention for the diagnosis, prognosis, and/or characterization of a disease, disorder, and/or condition is within the scope of the present invention. Among certain embodiments of the present invention is the use of one or more compositions of matter of the present invention (e.g. a pharmaceutical composition of the present invention) in the treatment or prevention of a cancer, tumor, abnormal growth condition, and/or immune disorder. Among certain embodiments of the present invention is the use of one or more compositions of matter of the invention (e.g. a pharmaceutical composition of the present invention) in the manufacture of a medicament for the treatment or prevention of a cancer, tumor, abnormal growth condition, and/or immune disorder.

The present invention further provides methods of treating diseases, disorders, and/or conditions in subjects, the method comprising the step of administering to a subject in need thereof a therapeutically effective amount of a multivalent CD20-binding molecule of the present invention, a multivalent CD20-binding molecule composition of the present invention, and/or a pharmaceutical composition of the present invention. For certain embodiments of these treatment methods of the invention, the disease, disorder, or condition to be treated using a method of the invention involves a cell, cancer cell, tumor cell, and/or immune cell which express CD20 at a cellular surface. For certain embodiments of these treatment methods of the invention, the disease, disorder, or condition to be treated using a method of the invention is a cancer, tumor, abnormal growth condition, and/or immune disorder. For certain embodiments of these treatment methods of the invention, the disease to be treated is selected from the group consisting of: hematologic cancer, leukemia, lymphoma, melanoma, and myeloma. For certain embodiments of these treatment methods of the invention, the immune disorder to be treated is selected from the group consisting of: amyloidosis, ankylosing spondylitis, asthma, Crohn's disease, diabetes, graft rejection, graft-versus-host disease, Graves' disease, Graves' ophthalmopathy, Hashimoto's thyroiditis, hemolytic uremic syndrome. HIV-related diseases, lupus erythematosus, multiple sclerosis, neuromyelitis optica spectrum disorders, N-methyl D-aspartate (NMDA) receptor encephalitis, opsoclonus myoclonus syndrome (OMS), paroxysmal nocturnal hemoglobinuria, polyarteritis nodosa, polyarthritis, psoriasis, psoriatic arthritis, rheumatoid arthritis, scleritis, scleroderma, septic shock, Sjorgren's syndrome, ulcerative colitis, and vasculitis. For certain embodiments of these treatment methods of the present invention, the cancer to be treated is selected from the group consisting of: acute myeloid leukemia (acute myelogenous leukemia or AML), acute non-lymphocytic leukemia, B-cell chronic lymphocytic leukemia (B-cell CLL), B-cell lymphoma, B-cell non-Hodgkin's lymphoma (B-cell NHL), B-cell precursor acute lymphoblastic leukemia (BCP-ALL or B-ALL), B-cell prolymphocytic leukemia (B-PLL). Burkitt's lymphoma (BL), chronic lymphocytic leukemia (CLL), chronic myeloid leukemia (CML), diffuse large B-cell lymphoma (DLBCL or DLBL), follicular lymphoma (FL), hairy cell leukemia (HCL), Hodgkin's lymphoma (HL or HD), immunoblastic large cell lymphoma, mantle cell lymphoma (MCL), multiple myeloma (MM), nodular lymphocyte predominant Hodgkin's lymphoma (NLPHL), non-Hodgkin's lymphoma (NHL), plasmablastic lymphoma, plasma cell neoplasma, plasma cell myeloma, precursor B-lymphoblastic lymphoma (B-LBL), small lymphocytic lymphoma (SLL), T-cell large granular lymphocyte leukemia (T-LGLL), T-cell lymphoma (TCL), T-cell prolymphocytic leukemia (T-PLL), and Waldenström's macroglobulinemia (WM).

Among certain embodiments of the present invention is a method of producing a multivalent CD20-binding molecule of the present invention and/or multivalent CD20-binding molecule composition, the method comprising the step of purifying a multivalent CD20-binding molecule or protein component thereof using an affinity purification step, such as, e.g., based on a chitin binding interaction. For certain further embodiments, the affinity purification step uses a chitin binding interaction. For certain further embodiments, the purifying step of the method involves the molecule comprising or consisting essentially of any one of the molecules shown in SEQ ID NOs: 4-304.

Among certain embodiments of the present invention is a method of using a multivalent CD20-binding protein of the invention comprising a detection promoting agent for the collection of information useful in the diagnosis, prognosis, or characterization of a disease, disorder, or condition. Among certain embodiments of the present invention is a method of detecting a cell using a multivalent CD20-binding protein and/or diagnostic composition of the invention, the method comprising the steps of contacting a cell with the multivalent CD20-binding protein and/or diagnostic composition of the invention and detecting the presence of the multivalent CD20-binding molecule and/or diagnostic composition. For certain embodiments, the step of contacting the cell(s) occurs in vitro and/or ex vivo. For certain embodiments, the step of contacting the cell(s) occurs in vivo. For certain embodiments, the step of detecting the cell(s) occurs in vitro and/or ex vivo. For certain embodiments, the step of detecting the cell(s) occurs in vivo.

Among certain embodiments of the present invention are kits comprising a composition of matter of the present invention, and optionally, instructions for use, additional reagent(s), and/or pharmaceutical delivery device(s).

These and other features, aspects and advantages of the present invention will become better understood with regard to the following description, appended claims, and accompanying figures. The aforementioned elements of the invention may be individually combined or removed freely in order to make other embodiments of the invention, without any statement to object to such combination or removal hereinafter.

BRIEF DESCRIPTION OF THE FIGURES

FIG. 1A and FIG. 1B show schematic representations of exemplary, multivalent CD20-binding molecules of the present invention that each comprise two CD20 binding regions. FIG. 1A shows schematic representations of exemplary, multivalent CD20-binding molecules of the invention where a small, vertical line may represent any suitable type of molecular association, such as, e.g., a single covalent bond like a disulfide bond or a linker, whether flexible or rigid; and a curved line may represent any suitable type of molecular association, such as, e.g., a flexible linker. FIG. 1B shows schematic representations of exemplary, multivalent CD20-binding molecules of the invention, which each comprise two CD20-binding regions derived from an immunoglobulin(s), and with examples of non-covalent, intermolecular associations as a result of intermolecular domain swapping between immunoglobulin-derived, CD20-binding regions. In FIG. 1B, the heavier weight lines represent any suitable type of molecular association, such as, e.g., a covalent bond or linker; and the lighter weight lines represent connections between immunoglobulin-derived domains of a CD20 binding region component, such as, e.g., a single covalent bond or a fifty amino acid residue linker. The schematic representations in FIG. 1A and FIG. 1B show exemplary forms of the multivalent CD20-binding molecules of the present invention that may represent different structural forms, including monomeric, heterodimeric, and/or homodimeric forms, such as, e.g., a homodimeric form stabilized by an inter-polypeptide disulfide bond(s) between two components of the molecule (e.g., Shiga toxin A Subunit effector regions and/or CD20 binding regions).

FIG. 2 graphically shows the sizes of different, exemplary, multivalent CD20-binding molecules of the present invention in different, exemplar) compositions of the present invention analyzed by size exclusion chromatography (SEC). In addition, FIG. 2 shows the purity of different, exemplary compositions of the present invention as analyzed by SEC. For the SEC analysis of three different samples, the absorbance of ultraviolet light at 280 nanometers (nm) of the material eluted after flowing through a SEC column in milli-absorbance units (mAU) was plotted over the elution volume (mL).

FIG. 3 shows a Coomassie-stained, sodium dodecyl sulfate, polyacrylamide gel after electrophoresis of exemplary, multivalent CD20-binding molecules of the present invention from exemplary multivalent CD20-binding molecules compositions of the present invention prepared in either reducing or non-reducing conditions. FIG. 3 shows the sizes of different, exemplary, multivalent CD20-binding molecules of the present invention analyzed by gel electrophoresis and the relative purity of proteinaceous molecules present in different, exemplary compositions of the present invention.

FIG. 4 graphically shows the binding affinity characteristics of exemplary, multivalent CD20-binding molecule compositions of the present invention and a monovalent CD20-binding protein composition to CD20 positive (CD20+) human tumor-derived, cells. The mean fluorescent intensity representing the amount of cell-bound, CD20-binding protein was plotted over the sample concentration of multivalent CD20-binding protein in nanograms per milliliter (ng/mL) analyzed.

FIG. 5 graphically shows the ribosomal inhibitory activity of different, exemplary, multivalent CD20-binding molecules of the present invention and a monovalent CD20-binding protein in percent of zero inhibition of protein synthesis in an in vitro translation assay. The percentage of protein synthesis of zero protein synthesis activity was plotted over the logarithm to base 10 of the molar concentration in picomolar of Shiga toxin component(s) present in each sample analyzed.

FIG. 6 graphically shows the cytotoxicities of exemplary, multivalent CD20-binding molecule compositions to CD20+ human derived tumor cells as compared to the cytotoxicity of a composition comprising the monovalent, CD20-binding protein component of the exemplary multivalent CD20-binding molecules of those exemplary, multivalent CD20-binding molecule compositions. The percentage of viable cells was plotted over the logarithm to base 10 of CD20-binding protein concentration in nanograms per milliliter (ng/mL).

FIG. 7 graphically shows the cytotoxicity of an exemplary, multivalent CD20-binding molecule composition to CD20+ human tumor-derived, cells as compared to a composition comprising the monovalent, CD20-binding protein component of the exemplary multivalent CD20-binding molecule(s) of that exemplary, multivalent CD20-binding molecule composition. In addition, FIG. 7 shows the cytotoxicity of a composition comprising a mixture of monovalent and multivalent CD20-binding molecules. The percent viability of cells was plotted over the logarithm to base 10 of CD20-binding protein concentration in nanograms per milliliter (ng/mL).

FIG. 8 graphically shows the cytotoxicities of various, fixed-ratio mixtures of purified, CD20-binding protein compositions to CD20+ human tumor-derived, cells. The percent viability of cells was plotted over the logarithm to base 10 of CD20-binding protein concentration in nanograms per milliliter (ng/mL).

FIG. 9 graphically shows the cytotoxicities of an exemplary, multivalent CD20-binding protein composition and fixed-ratio mixtures of purified, CD20-binding protein compositions to CD20 negative (CD20-) human tumor-derived, cells. The percent viability of cells was plotted over the logarithm to base 10 of CD20-binding protein concentration in nanograms per milliliter (ng/mL).

FIG. 10 graphically shows the cytotoxicities (in $CD_{50}$ concentrations) to CD20+ human tumor-derived, cells of different, multivalent CD20-binding protein compositions which varied in their proportions of multivalent CD20-binding molecule(s) to monovalent CD20-binding protein. $CD_{50}$ values in nanograms per milliliter (ng/mL) of different, fixed-ratio, CD20-binding protein mixtures were plotted over the protein concentration percentages of multivalent (αCD20-scFv::SLT-1A)$_2$ composition present in the sample tested. In addition, FIG. 10 shows a line which was fit to the data points using linear regression statistical modeling and the resulting coefficient of determination (R squared) of that line fit.

FIG. 11 graphically shows the cytotoxicities (in $CD_{50}$ concentrations) to CD20+ human tumor-derived, cells of different, multivalent CD20-binding protein compositions which varied in their proportions of multivalent CD20-binding molecule(s) to monovalent CD20-binding protein. $CD_{50}$ values in nanograms per milliliter (ng/mL) of different, fixed ratio, CD20-binding protein mixtures were graphed over the protein concentration percentages of multivalent ($\alpha$CD20-scFv::SLT-1A)$_2$ composition present in the sample tested.

FIG. 12A, FIG. 12B, and FIG. 12C graphically show the sizes and proportions of molecules present in different, exemplary, multivalent CD20-binding molecule compositions of the present invention analyzed by size exclusion chromatography (SEC). For the SEC analysis, the absorbance of ultraviolet light at 280 nm of the material eluted after flowing through a SEC column was plotted in milli-absorbance units (mAU) over the elution time (minutes). Software was used to identify individual peaks in the 280 nm trace and the retention time of each peak's maximum absorbance of ultraviolet light at 280 nm.

DETAILED DESCRIPTION

The present invention is described more fully hereinafter using illustrative, non-limiting embodiments, and references to the accompanying figures. This invention may, however, be embodied in many different forms and should not be construed as to be limited to the embodiments set forth below. Rather, these embodiments are provided so that this disclosure is thorough and conveys the scope of the invention to those skilled in the art.

In order that the present invention may be more readily understood, certain terms are defined below. Additional definitions may be found within the detailed description of the invention.

As used in the specification and the appended claims, the terms "a," "an" and "the" include both singular and the plural referents unless the context clearly dictates otherwise.

As used in the specification and the appended claims, the term "and/or" when referring to two species, A and B, means at least one of A and B. As used in the specification and the appended claims, the term "and/or" when referring to greater than two species, such as A. B, and C, means at least one of A, B, or C, or at least one of any combination of A, B, or C (with each species in singular or multiple possibility).

Throughout this specification, the word "comprise" or variations such as "comprises" or "comprising" will be understood to imply the inclusion of a stated integer (or components) or group of integers (or components), but not the exclusion of any other integer (or components) or group of integers (or components).

Throughout this specification, the term "including" is used to mean "including but not limited to." "Including" and "including but not limited to" are used interchangeably.

The term "amino acid residue" or "amino acid" includes reference to an amino acid that is incorporated into a protein, polypeptide, or peptide. The term "polypeptide" includes any polymer of amino acids or amino acid residues. The term "polypeptide sequence" refers to a series of amino acids or amino acid residues from which a polypeptide is physically composed. A "protein" is a macromolecule comprising one or more polypeptides or polypeptide "chains." A "peptide" is a small polypeptide of sizes less than about 15 to 20 amino acid residues. The term "amino acid sequence" refers to a series of amino acids or amino acid residues which physically comprise a peptide or polypeptide depending on the length. Unless otherwise indicated, polypeptide and protein sequences disclosed herein are written from left to right representing their order from an amino terminus to a carboxy terminus.

The terms "amino acid." "amino acid residue," "amino acid sequence," or polypeptide sequence include naturally occurring amino acids (including L and D isosteriomers) and, unless otherwise limited, also include known analogs of natural amino acids that can function in a similar manner as naturally occurring amino acids, such as, e.g., selenocysteine, pyrrolysine, N-formylmethionine, gamma-carboxyglutamate, hydroxyprolinehypusine, pyroglutamic acid, and selenomethionine. The amino acids referred to herein are described by shorthand designations as follows in Table A:

TABLE A

Amino Acid Nomenclature

| Name | 3-letter | 1-letter |
|---|---|---|
| Alanine | Ala | A |
| Arginine | Arg | R |
| Asparagine | Asn | N |
| Aspartic Acid or Aspartate | Asp | D |
| Cysteine | Cys | C |
| Glutamic Acid or Glutamate | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

The phrase "conservative substitution" with regard to a polypeptide, refers to a change in the amino acid composition of the polypeptide that does not substantially alter the function and structure of the overall polypeptide (see Creighton, *Proteins: Structures and Molecular Properties* (W. H. Freeman and Company, New York (2nd ed., 1992)).

As used herein, the terms "expressed," "expressing," or "expresses," and grammatical variants thereof, refer to translation of a polynucleotide or nucleic acid into a polypeptide and/or protein. The expressed polypeptides or proteins may remain intracellular, become a component of the cell surface membrane or be secreted into an extracellular space.

As used herein, the meaning of the phrase "CD20-expressing cell" encompasses any cell that expresses, at a cellular surface, a CD20 molecule which comprises a transmembrane domain.

As used herein, cells which express a significant amount of CD20 at least one cellular surface are "CD20 positive cells" or "CD20+ cells" and are cells physically coupled to the extracellular target biomolecule CD20. A significant amount of CD20 is defined below in Section III-B.

As used herein, the symbol "$\alpha$" is shorthand for an immunoglobulin-type binding region capable of binding to the biomolecule following the symbol. The symbol "$\alpha$" is used to refer to the functional characteristic of an immunoglobulin-type binding region based on its capability of binding to the biomolecule following the symbol.

The symbol "::" means the polypeptide regions before and after it are physically linked together to form a continuous polypeptide.

For purposes of the present invention, the term "effector" means providing a biological activity, such as cytotoxicity, biological signaling, enzymatic catalysis, subcellular routing, and/or intermolecular binding resulting in the recruitment of one or more factors and/or allosteric effect(s).

As used herein, the phrase "multivalent CD20-binding molecule" refers to a CD20-binding molecule or plurality of CD20-binding molecules comprising two or more high-affinity CD20 binding regions, such as, e.g. a protein comprising two or more CD20 binding regions where each individual binding region has a dissociation constant of $10^{-5}$ to $10^{-12}$ moles per liter toward an extracellular part of CD20.

As used herein, the phrase "multivalent CD20-binding protein" refers to a CD20-binding protein molecule or plurality of CD20-binding protein molecules comprising two or more high-affinity CD20 binding regions, such as, e.g. a protein comprising two or more CD20 binding regions where each individual binding region has a dissociation constant of $10^{-5}$ to $10^{-12}$ moles/liter toward an extracellular part of CD20.

For purposes of the present invention, the phrase "derived from" means that the polypeptide region comprises amino acid sequences originally found in a protein and which may now comprise additions, deletions, truncations, rearrangements, or other alterations relative to the original sequence as long as the overall function and structure are substantially conserved.

For purposes of the present invention, a Shiga toxin effector function is a biological activity conferred by a polypeptide region derived from a Shiga toxin A Subunit. Non-limiting examples of Shiga toxin effector functions include cellular internalization, subcellular routing, catalytic activity, and cytotoxicity. Shiga toxin catalytic activities include, for example, ribosome inactivation, protein synthesis inhibition, N-glycosidase activity, polynucleotide:adenosine glycosidase activity, RNAase activity, and DNAase activity. Shiga toxins are ribosome inactivating proteins (RIPs). RIPs can depurinate nucleic acids, polynucleosides, polynucleotides, rRNA, ssDNA, dsDNA, mRNA (and polyA), and viral nucleic acids (see e.g. Brigotti M et al., *Toxicon* 39: 341-8 (2001); Brigotti M et al., *FASEB J* 16: 365-72 (2002)). Some RIPs show antiviral activity and superoxide dismutase activity. Shiga toxin catalytic activities have been observed both in vitro and in vivo. Non-limiting examples of assays for Shiga toxin effector activity measure protein synthesis inhibitory activity, depurination activity, inhibition of cell growth, cytotoxicity, supercoiled DNA relaxation activity, and nuclease activity.

As used herein, the retention of Shiga toxin effector function refers to a level of Shiga toxin functional activity, as measured by an appropriate quantitative assay with reproducibility comparable to a wild-type Shiga toxin effector region control. For ribosome inhibition, Shiga toxin effector function is exhibiting an $IC_{50}$ of 10,000 picomolar (pM) or less. For cytotoxicity in a target positive cell kill assay, Shiga toxin effector function is exhibiting a $CD_{50}$ of 1,000 nanomolar (nM) or less, depending on the cell type and its expression of the appropriate extracellular CD20 target biomolecule.

As used herein, the retention of "significant" Shiga toxin effector function refers to a level of Shiga toxin functional activity, as measured by an appropriate quantitative assay with reproducibility comparable to a wild-type Shiga toxin effector polypeptide control. For in vitro ribosome inhibition, significant Shiga toxin effector function is exhibiting an $IC_{50}$ of 300 pM or less depending on the source of the ribosomes (e.g. bacteria, archaea, or eukaryote (algae, fungi, plants, or animals)). This is significantly greater inhibition as compared to the approximate $IC_{50}$ of 100,000 pM for the catalytically inactive SLT-1A 1-251 double mutant (Y77S/E167D). For cytotoxicity in a target positive cell kill assay in laboratory cell culture, significant Shiga toxin effector function is exhibiting a $CD_{50}$ of 100, 50, or 30 nM or less, depending on the cell line and its expression of the appropriate extracellular CD20 target biomolecule. This is significantly greater cytotoxicity to the appropriate target cell line as compared to an SLT-1A subunit alone, without a cell targeting binding region, which has a $CD_{50}$ of 100-10,000 nM, depending on the cell line.

For some samples, accurate values for either $IC_{50}$ or $CD_{50}$ might be unobtainable due to the inability to collect the required data points for an accurate curve fit. For example, theoretically, neither an $IC_{50}$ nor $CD_{50}$ can be determined if greater than 50% ribosome inhibition or cell death, respectively, does not occur in a concentration series for a given sample. Inaccurate $IC_{50}$ and/or $CD_{50}$ values should not be considered when determining significant Shiga toxin effector function activity. Data insufficient to accurately fit a curve as described in the analysis of the data from exemplary Shiga toxin effector function assays, such as, e.g., assays described in the Examples, infra, should not be considered as representative of actual Shiga toxin effector function.

A failure to detect activity in Shiga toxin effector function may be due to improper expression, polypeptide folding, and/or polypeptide stability rather than a lack of cell entry, subcellular routing, and/or enzymatic activity. Assays for Shiga toxin effector functions may not require much multivalent CD20-binding molecule of the invention to measure significant amounts of Shiga toxin effector function activity. To the extent that an underlying cause of low or no effector function is determined empirically to relate to protein expression or stability, one of skill in the art may be able to compensate for such factors using protein chemistry and molecular engineering techniques known in the art, such that a Shiga toxin functional effector activity may be restored and measured. As examples, improper cell-based expression may be compensated for by using different expression control sequences; improper polypeptide folding and/or stability may benefit from stabilizing terminal sequences, or compensatory mutations in non-effector regions which stabilize the three-dimensional structure of the protein, etc. When new assays for individual Shiga toxin functions become available, Shiga toxin effector regions or polypeptides may be analyzed for any level of those Shiga toxin effector functions, such as for being within a certain-fold activity of a wild-type Shiga toxin effector polypeptide. Examples of meaningful activity differences are, e.g., Shiga toxin effector regions that have 1000-fold or 100-fold or less the activity of a wild-type Shiga toxin effector polypeptide; or that have 3-fold to 30-fold or more activity compared to a functional knock-down or knockout Shiga toxin effector polypeptide.

Certain Shiga toxin effector functions are not easily measurable, e.g. subcellular routing functions. Currently there is no routine, quantitative assay to distinguish whether the failure of a Shiga toxin effector polypeptide to be cytotoxic is due to improper subcellular routing, but at a time when tests are available, Shiga toxin effector polypeptides may be analyzed for any significant level of subcellular routing as compared to the appropriate wild-type Shiga toxin effector region.

It should be noted that even if the cytotoxicity of a Shiga toxin effector polypeptide is reduced relative to wild-type, in practice, applications using attenuated, Shiga toxin effector polypeptides may be equally or more effective than those using wild-type, Shiga toxin effector polypeptides because the highest potency variants might exhibit undesirable effects which are minimized or reduced in reduced-potency variants. Wild-type Shiga toxin effector polypeptides are very potent, being able to kill with only one molecule reaching the cytosol or perhaps 40 molecules being internalized (Tam P, Lingwood C, *Microbiology* 153: 2700-10 (2007)). Shiga toxin effector polypeptides with even considerably reduced Shiga toxin effector functions, such as, e.g., subcellular routing or cytotoxicity, as compared to wild-type Shiga toxin effector polypeptides may still be potent enough for practical applications involving targeted cell killing and/or detection of certain subcellular compartments of specific cell types. And such effector polypeptides may also be useful for delivering cargos (e.g. additional exogenous material) to certain intracellular locations or subcellular compartments.

The term "selective cytotoxicity" with regard to the cytotoxic activity of a cytotoxic, multivalent CD20-binding molecule refers to the relative levels of cytotoxicity between a targeted cell population and a non-targeted bystander cell population, which can be expressed as a ratio of the half-maximal cytotoxic concentration ($CD_{50}$) for a targeted cell type over the $CD_{50}$ for an untargeted cell type to show the preferentially of cell killing of the targeted cell type as a metric for selectivity.

As used in the specification and the claims herein, the phrase "physiological temperature appropriate for the cell" refers to temperatures known in the art and/or identifiable by the skilled worker which fall within a range suitable for healthy growth, propagation, and/or function of that particular cell or cell type; corresponding to the core temperature of the species from which the cell is derived; and/or corresponding to a healthy, living organism comprising the cell. For example, temperatures around 37° C. are appropriate for many mammalian cells depending on the species.

For purposes of the present invention, the phrase "internalization of a molecular complex comprising the multivalent CD20-binding molecule bound to CD20" means the cellular internalization of the multivalent CD20-binding molecule is CD20-mediated in that the internalization begins with multivalent CD20-binding molecule and cell-surface CD20 forming a complex at an extracellular position and ends with both the multivalent CD20-binding molecule and CD20 molecule(s) entering the cell prior to dissociation of the multivalent CD20-binding molecule from CD20 molecule(s) to which the multivalent CD20-binding molecule has bound.

For purposes of the present invention, the phrase "CD20 natively present on the surface of a cell" means a cell expresses the CD20 molecule using its own protein synthesis machinery and localizes the CD20 molecule to a cellular surface using its own intracellular routing machinery such that the CD20 molecule is physically coupled to said cell and at least a part of the CD20 molecule is accessible from an extracellular space, i.e. on the surface of a cell.

For the purposes of certain embodiments of the present invention, cellular internalization is considered rapid if the time for internalization to occur due to the binding of the multivalent CD20-binding molecule of the present invention is reduced as compared to the time for internalization of a prior art reference molecule at the same percent CD20 occupancy as determined by the same assay using the same cell type at the same temperature.

As used in the specification and the claims herein, the phrase "rapid cellular internalization" refers to the ability of a multivalent CD20-binding molecule of the present invention to decrease the time on average for cellular internalization of an extracellular CD20 antigen or cell surface localized CD20 molecule as compared to the time on average required for cellular internalization of an extracellular CD20 antigen or cell surface localized CD20 molecule, as measured by any one of a number of cell internalization assays known in the art or described herein.

As used in the specification and the claims herein, the phrase "rapid internalization" includes internalization which may be assayed as compared to a basal CD20 internalization rate and/or molecular binding induced internalization rate for CD20 after administration of an immunoglobulin-type binding molecule (e.g. a monoclonal antibody) known in the art to bind an extracellular part of CD20. The scope of the phrase "rapid cellular internalization" is intended to encompass internalization rates, on average, faster than those observed when testing a CD20-specific antibody or immunoglobulin-derived protein molecule with an Fc region. In general, an internalization rate constant may be defined as the time after administration of a CD20-specific binding molecule of interest to CD20 positive cells at which 50% of cell surface CD20 antigens, CD20 molecules, and/or the CD20-specific binding molecule is internalized at a given administered concentration, mass, molarity, or CD20 occupancy-adjusted concentration, to a particular cell type, and at a particular temperature. Cell-surface CD20 internalization, whether basally or in response to administration of a CD20-binding molecule, may be assayed by various methods known to the skilled worker (see e.g. Press O et al., *Blood.* 83: 1390-7 (1994); Golay J et al., *Blood* 98: 3383-9 (2001); Goulet A et al., *Blood* 90: 2364-75 (1997); Manches O et al., *Blood* 101: 949-54 (2003); Hess G et al., *Biochim Biophys Acta* 1773: 1583-8 (2007); Baskar S et al., *Clin Cancer Res* 14: 396-404 (2008); Luqman M et al., *Blood* 112: 711-20 (2008)).

For the purposes of certain embodiments of the present invention, cellular internalization is considered rapid if the time for internalization to occur due to the binding of the multivalent CD20-binding molecule of the present invention is reduced as compared to the time for internalization of the target CD20 molecule with the binding of a well-characterized antibody recognizing a CD20 antigen, such as the αCD20 monoclonal antibody 1H4 (Haisma H et al., *Blood* 92: 184-90 (1999)). For example, internalization timing for the CD20 antigen, although variable for cell type and antibody type, does not typically begin to reach maximal levels until approximately six hours or more after binding. Thus the term "rapid" as used throughout the present description is intended to indicate that a multivalent CD20-binding molecule of the present invention enters one or more CD20-expressing and/or CD20 positive cells in less than six hours. In certain embodiments, rapid can be as quickly as less than about thirty minutes, but can also encompass a range of from about 1 hour to about 2 hours, to about 3 hours, to about 4 hours, to about 5 hours; a range of about 2 hours to about 3 hours, to about 4 hours, to about 5 hours; a range of about 3 hours to about 4 hours, to about 5 hours; and a range of about 4 hours to about 5 hours.

For purposes of the present invention, the phrase "one or more non-covalent linkages," with regard to a molecule comprising two or more components linked together, includes the types of linkages connecting the components that in certain molecules may be observed as being eliminated (i.e., no longer connecting two or more components) when changing the molecule from native protein-folding conditions to protein-denaturing conditions. For example, when using techniques known in the art and/or described herein, such as, e.g., electrophoretic and/or chromatographic assays, for assaying the sizes of proteinaceous molecules, a multi-component molecule that appears as a single-sized species under native protein-folding conditions (e.g. pH-buffered environments intended to be similar to the lumen of the endoplasmic reticulum of a eukaryotic cell or to an extracellular environment within an organism), can also be observed as being composed of two or more smaller-sized, proteinaceous molecules under denaturing conditions and/or after being subjected to a denaturing condition. "Protein-denaturing" conditions are known to the skilled worker and include conditions markedly different from native protein-folding conditions, such as, e.g., environments with a high temperature (e.g., greater than 50 degrees Celsius) and/or those characterized by the presence of chemical denaturants and/or detergents, such as, e.g., 1-10% sodium dodecyl sulfate, polysorbates, Triton® X-100, sarkosyl, and other detergents whether ionic, non-ionic, zwitterionic, and/or chaotropic.

As used herein, the term "monomeric" with regard to describing a protein and/or proteinaceous molecule refers to a molecule comprising only one polypeptide component consisting of a single, continuous polypeptide, regardless of its secondary or tertiary structure, which may be synthesized by a ribosome from a single polynucleotide template, including a continuous linear polypeptide which later forms a cyclic structure. In contrast, a multimeric molecule may comprise two or more polypeptides (e.g. subunits) which together do not form a single, continuous polypeptide that may be synthesized by a ribosome from a single polynucleotide template.

As used herein, the term "multimeric" with regard to describing a protein and/or proteinaceous molecule refers to a molecule that comprises two or more, individual, polypeptide components associated together and/or linked together, such as, e.g., a molecule consisting of two components each of which is its own continuous polypeptide. For example, the association or linkage between components of a molecule may include 1) one or more non-covalent interactions; 2) one or more post-translational, covalent interactions; 3) one or more, covalent chemical conjugations; and/or 4) one or more covalent interactions resulting in a single molecule comprising a non-linear polypeptide, such as, e.g., a branched or cyclic polypeptide structure, resulting from the arrangement of the two or more polypeptide components. A molecule comprising two, discontinuous polypeptides as a result of the proteolytic cleavage of one or more peptide bonds in a single, continuous polypeptide synthesized by a ribosome from a single polynucleotide templates is "multimeric" and not "monomeric."

As used herein, the phrase "CD20-binding molecule composition" refers to a composition comprising at least one type of CD20-binding molecule, and, may commonly comprise two or more types of CD20-binding molecule, wherein each type of CD20-binding molecule has a reproducibly measurable representation in the composition, e.g., of at least one percent (by mass) of the most abundant type of CD20-binding molecule. A composition comprising only one type of CD20-binding molecule with no other type of proteinaceous molecule present (e.g. a composition comprising one hundred percent of a single type of CD20-binding molecule of the total proteinaceous molecule(s) present) is encompassed by the phrase "CD20-binding molecule composition."

INTRODUCTION

The present invention provides multivalent CD20-binding molecules comprising Shiga-toxin-Subunit-A derived regions associated with multiple, heterologous, CD20 binding regions for cell targeting. In addition, the present invention provides compositions enriched for multivalent CD20-binding molecules of the present invention (e.g. a composition comprising a relatively large proportion of multivalent CD20-binding molecule relative to monovalent CD20-binding molecule). The present invention is based on the discovery that several, multivalent CD20-binding molecules were much more cytotoxic to CD20-expressing cells than a monovalent CD20-binding protein component in a way that was not predictable from differences in binding affinity to CD20-expressing cells and/or CD20-binding valence (see Examples, infra).

As described in more detail in the Examples, certain, exemplary, multivalent CD20-binding molecules, and compositions thereof, exhibited unexpectedly large cytotoxic potencies compared to what was measured using equivalent amounts of a monovalent CD20-binding variant, and certain compositions thereof. Without being bound by theory, the multivalent CD20-binding molecules of the present invention, and compositions thereof, may possess the improved ability(ies) of: internalizing into CD20-expressing cells, intracellularly routing to a certain subcellular compartment(s), and/or delivering an active toxin effector polypeptide region (e.g., a Shiga toxin A Subunit effector polypeptide) to the cytosol as compared to certain 1) monovalent CD20-binding molecules and compositions thereof, 2) multivalent CD20-binding molecules lacking a toxin effector region(s) (e.g., a Shiga toxin A Subunit effector polypeptide), and/or compositions comprising high-proportions of monovalent CD20-binding molecule(s) comprising Shiga toxin A Subunit effector polypeptide(s) to total CD20-binding molecule.

I. The General Structure of the Multivalent CD20-Binding Molecules of the Present Invention The present invention provides various multivalent CD20-binding molecules for targeted cellular internalization into CD20-expressing cell types. A CD20-binding molecule of the present invention comprises 1) two or more CD20 binding regions, each capable of specifically binding an extracellular part of CD20, and 2) at least one Shiga toxin effector region comprising a polypeptide derived from the amino acid sequence of an A Subunit of at least one member of the Shiga toxin family. The linking of multiple cell targeting CD20 binding regions with Shiga-toxin-Subunit-A-derived regions enables the specific targeting of the potent Shiga toxin cytotoxicity to CD20+ cell types. The present invention also provides various compositions comprising large-proportions of multivalent CD20-binding molecules of the present invention for applications involving targeting cellular internalization into CD20-expressing cell types.

Certain multivalent CD20-binding molecules of the present invention, and compositions thereof, are cytotoxic and others are not, such as, e.g., for labeling the interiors of CD20-expressing cells. Certain multivalent CD20-binding molecules of the present invention, and compositions thereof, can deliver additional exogenous materials into CD20-expressing cells and may or may not result in cytotoxicity independent of the activity of the Shiga toxin effector region.

A. CD20 Binding Regions of a Multivalent CD20-Binding Molecule of the Present Invention The multivalent CD20-binding molecule of the present invention comprises two or more CD20 binding regions wherein each binding region comprises a peptide or polypeptide region capable of binding specifically to an extracellular part of a CD20 molecule. In certain embodiments, the multivalent CD20-binding molecule of the present invention comprises two or more CD20 binding regions wherein each binding region comprises a peptide or polypeptide region capable of binding specifically to an extracellular part of a CD20 molecule in physical association with a cell. The CD20 binding region may comprise one or more various peptidic or polypeptide moieties, such as randomly generated peptide sequences, naturally occurring ligands or derivatives thereof, immunoglobulin-derived domains, engineered scaffolds as alternatives to immunoglobulin domains, and the like.

For purposes of the present invention, the term "CD20 binding region" refers to a proteinaceous (e.g., peptidic and/or polypeptide) region of a molecule of the present invention which is capable of specifically binding an extracellular part of a CD20 molecule with high affinity, such as, e.g., having a dissociation constant with regard to CD20 of $10^{-5}$ to $10^{-12}$ moles per liter.

In certain embodiments, the binding region of a multivalent CD20-binding molecule of the present invention comprises a polypeptide capable of selectively and specifically binding an extracellular part of a CD20 expressed at a cellular surface and in physical association with a cell. In certain embodiments, the CD20 binding region comprises a naturally occurring ligand of a CD20 molecule or derivative thereof that retains binding functionality to an extracellular part of CD20. According to certain other embodiments, the CD20 binding region comprises a synthetic ligand capable of binding to an extracellular part of CD20 with high affinity.

While the name CD20 might refer to multiple proteins with related structures and polypeptide sequences from various species, for the purposes of the present invention, the term "CD20" refers to the B-lymphocyte antigen CD20 proteins present in mammals whose exact sequence might vary slightly based on the isoform and from individual to individual. Alternative names for CD20, as recognized in the art, include B-lymphocyte surface antigen B1, Leu-16 and Bp35. For example, in humans CD20 refers to the protein represented by the predominant polypeptide sequence UnitProt P11836 and NCBI accession NP 690605.1; however, different isoforms and variants may exist. The polypeptide sequences of CD20 proteins from various species have been described, such as from bats, cats, cattle, dogs, mice, marmosets, and rats, and can be predicted by bioinformatics in numerous other species based on genetic homology (e.g. CD20 has been predicted in various primates, including baboons, macaques, gibbons, chimpanzees, and gorillas) (see NCBI protein database (National Center for Biotechnology Information, U.S.)). A skilled worker will be able to identify a CD20 related protein in mammals, even if it differs from the referenced sequences.

CD20 is expressed by B-cells within certain cell developmental stages that give rise to non-Hodgkins lymphoma (NHL) and chronic lymphocytic leukemia (CLL); however, CD20 is not expressed on hematopoietic stem cells or on mature plasma cells (van Meerten T et al., *Clin Cancer Res* 12: 4027-35 (2006)). An attractive characteristic of CD20 is that it represents a quasi-universal target of lymphoma cells for being expressed on approximately 90% of B-cell non-Hodgkin lymphomas (Anderson K et al., *Blood* 63: 2825-33 (1984); Press O et al., *Cancer Res* 49: 4906-12 (1989); Press O et al., *Blood* 83: 1390-7 (1994); Manches O et al., *Blood* 101: 949-54 (2003)). Additional attractive characteristics of CD20 are its high expression on the plasma membrane of lymphoma cells and its multiple extracellular CD20 antigenic epitopes in close proximity to the plasma membrane (Teeling J et al., *J Immunol* 177: 362-71 (2006); Lim S et al., *Haematologica* 95: 135-43 (2010)).

An extracellular part of a CD20 molecule refers to a portion of its structure exposed to the extracellular environment when the CD20 molecule is present in a cell membrane, such as, e.g., CD20 molecules natively expressed at a cellular surface. In this context, exposed to the extracellular environment means that part of the CD20 molecule is accessible by, e.g., an antibody or at least a binding moiety smaller than an antibody such as a single-domain antibody domain, a nanobody, a heavy-chain antibody domain derived from camelids or cartilaginous fishes, a single-chain variable fragment, or any number of engineered alternative scaffolds to immunoglobulins (see below). The exposure to the extracellular environment of or accessibility to a part of CD20 physically coupled to a cell may be empirically determined by the skilled worker using methods well known in the art. Note that some portion of CD20, which was predicted not to be accessible to an antibody in the extracellular space based on its epitope location within CD20, was empirically shown to be accessible by a monoclonal antibody (Teeling J et al., *J. Immunol*. 177: 362-71 (2006)).

CD20 binding regions may be derived from antibody or antibody-like structures; however, alternative scaffolds from other sources are contemplated as a source of CD20 binding regions within the scope of the present invention. In certain embodiments, the CD20 binding region is derived from an immunoglobulin-derived binding region, such as an antibody paratope. In certain other embodiments, the CD20 binding region comprises an immunoglobulin-type binding region that is an engineered polypeptide not derived from any immunoglobulin domain.

According to one specific, but non-limiting aspect, the CD20 binding region may comprise an immunoglobulin-type binding region. The term "immunoglobulin-type binding region" as used herein refers to a polypeptide region capable of binding one or more target biomolecules, such as an antigen or epitope. Immunoglobulin-type binding regions are functionally defined by their ability to bind to target molecules, and all the immunoglobulin-type binding regions of the present invention are capable of binding CD20. Immunoglobulin-type binding regions are commonly derived from antibody or antibody-like structures; however, alternative scaffolds from other sources are contemplated within the scope of the term.

Immunoglobulin (Ig) proteins have a structural domain known as an Ig domain. Ig domains range in length from about 70-110 amino acid residues and possess a characteristic Ig-fold, in which typically 7 to 9 antiparallel beta strands arrange into two beta sheets which form a sandwich-like structure. The Ig fold is stabilized by hydrophobic amino acid interactions on inner surfaces of the sandwich and highly conserved disulfide bonds between cysteine residues in the strands. Ig domains may be variable (IgV or V-set), constant (IgC or C-set) or intermediate (IgI or I-set). Some Ig domains may be associated with a complementarity determining region or complementary determining region (CDR), also referred to as antigen binding region (ABR), which is important for the specificity of antibodies binding to their epitopes. Ig-like domains are also found in non-immunoglobulin proteins and are classified on that basis as members of the Ig superfamily of proteins. The HUGO Gene Nomenclature Committee (HGNC) provides a list of members of the Ig-like domain containing family.

As used herein, the term "heavy chain variable ($V_H$) domain" or "light chain variable ($V_L$) domain" respectively refer to any antibody $V_H$ or $V_L$ domain (e.g. a human $V_H$ or $V_L$ domain) as well as any derivative thereof retaining at least qualitative antigen binding ability of the corresponding native antibody (e.g a humanized $V_H$ or $V_L$ domain derived from a native murine $V_H$ or $V_L$ domain). A $V_H$ or $V_L$ domain consists of a "framework" region interrupted by the three CDRs or ABRs. The framework regions serve to align the CDRs for specific binding to an epitope of an antigen. From amino-terminus to carboxyl-terminus, both $V_H$ and $V_L$ domains comprise the following framework (FR) and CDR regions: FR1, CDR1, FR2, CDR2, FR3, CDR3, and FR4. For camelid $V_H$H fragments. IgNARs of cartilaginous fish, $V_{NAR}$ fragments, and derivatives thereof, there is a single heavy chain variable domain comprising the same basic arrangement: FR1, CDR1, FR2, CDR2, FR3, CDR3, and FR4.

An immunoglobulin-type binding region may be a polypeptide sequence of antibody or antigen-binding fragment thereof wherein the amino acid sequence has been varied from that of a native antibody or an Ig-like domain of a non-immunoglobulin protein, for example by molecular engineering or library screening. Because of the relevance of recombinant DNA techniques and in vitro library screening in the generation of immunoglobulin-type binding regions, antibodies can be redesigned to obtain desired characteristics, such as smaller size, cell entry, or other therapeutic improvements. The possible variations are many and may range from the changing of just one amino acid to the complete redesign of, for example, a variable region. Typically, changes in the variable region will be made in order to improve the antigen-binding characteristics, improve variable region stability, or reduce the potential for immunogenic responses.

There are numerous immunoglobulin-type binding regions that bind an extracellular part of CD20 contemplated according to the present invention. In certain embodiments, the immunoglobulin-type binding region is derived from an immunoglobulin binding region, such as an antibody paratope capable of binding an extracellular part of CD20. In certain other embodiments, the immunoglobulin-type binding region comprises an engineered polypeptide not derived from any immunoglobulin domain but that functions like an immunoglobulin binding region by providing high-affinity binding to an extracellular part of CD20. This engineered polypeptide may optionally include polypeptide scaffolds comprising or consisting essentially of complementary determining regions from immunoglobulins as described herein.

There are numerous immunoglobulin-derived binding regions and non-immunoglobulin engineered polypeptides in the prior art that are useful for targeting the multivalent CD20-binding molecules of the present invention to CD20-expressing cells. In certain embodiments, the immunoglobulin-type binding region of the multivalent CD20-binding molecule of the invention is selected from the group which includes autonomous $V_H$ domains, single-domain antibody domains (sdAbs), heavy-chain antibody domains derived from camelids ($V_H$H fragments or $V_H$ domain fragments), heavy-chain antibody domains derived from camelid $V_H$H fragments or $V_H$ domain fragments, heavy-chain antibody domains derived from cartilaginous fishes, immunoglobulin new antigen receptors (IgNARs), $V_{NAR}$ fragments, single-chain variable (scFv) fragments, nanobodies, Fd fragments consisting of the heavy chain and $C_H1$ domains, permutated Fvs (pFvs), single chain Fv-$C_H3$ minibodies, dimeric $C_H2$ domain fragments ($C_H2D$), Fc antigen binding domains (Fcabs), isolated complementary determining region 3 (CDR3) fragments, constrained framework region 3, CDR3, framework region 4 (FR3-CDR3-FR4) polypeptides, small modular immunopharmaceutical (SMIP) domains, scFv-Fc fusions, multimerizing scFv fragments (diabodies, triabodies, tetrabodies), disulfide stabilized antibody variable (Fv) fragments, disulfide stabilized antigen-binding (Fab) fragments consisting of the $V_L$, $V_H$, $C_L$ and $C_H1$ domains, bivalent nanobodies, bivalent minibodies, bivalent F(ab')$_2$ fragments (Fab dimers), bispecific tandem $V_H$H fragments, bispecific tandem scFv fragments, bispecific nanobodies, bispecific minibodies, and any genetically manipulated counterparts of the foregoing that retain its paratope and binding function (see Ward E et al., *Nature* 341: 544-6 (1989); Davies J, Riechmann L, *Biotechnology* (NY) 13: 475-9 (1995); Brinkmann U et al., *J Mol Biol* 268: 107-17 (1997); Reiter Y et al., *Mol Biol* 290: 685-98 (1999); Riechmann L, Muyldermans S. *J Immunol Methods* 231: 25-38 (1999); Tanha J et al., *J Immunol Methods* 263: 97-109 (2002); Vranken W et al., *Biochemistry* 41: 8570-9 (2002); Jespers L et al., *J Mol Biol* 337: 893-903 (2004); Jespers L et al., *Nat Biotechnol* 22: 1161-5 (2004); To R et al., *J Biol Chem* 280: 41395-403 (2005); Saerens D et al., *Curr Opin Pharmacol* 8: 600-8 (2008); Dimitrov D, MAbs 1: 26-8 (2009); Weiner L, *Cell* 148: 1081-4 (2012); Ahmad Z et al., *Clin Dev Immunol* 2012: 980250 (2012)). There are a variety of binding regions comprising polypeptides derived from the constant regions of immunoglobulins, such as, e.g., engineered dimeric Fc domains, monomeric Fcs (mFcs), scFv-Fcs, $V_H$H-Fcs, $C_H2$ domains, monomeric $C_H3$s domains (m$C_H3$s), synthetically reprogrammed immunoglobulin domains, and/or hybrid fusions of immunoglobulin domains with ligands (Hofer T et al., *Proc Natl Acad Sci USA* 105: 12451-6 (2008); Xiao J et al., *J Am Chem Soc* 131: 13616-13618 (2009); Xiao X et al., *Biochem Biophys Res Commun* 387: 387-92 (2009); Wozniak-Knopp G et al., *Protein Eng Des Sel* 23 289-97 (2010); Gong R et al., *PLoS ONE* 7: e42288 (2012); Wozniak-Knopp G et al., *PLoS ONE* 7: e30083 (2012); Ying T et al., *J Biol Chem* 287: 19399-408 (2012); Ying T et al., *J Biol Chem* 288: 25154-64 (2013); Chiang M et al., *J Am Chem Soc* 136: 3370-3 (2014); Rader C, *Trends Biotechnol* 32: 186-97 (2014) Ying T et al., *Biochimica Biophys Acta* 1844: 1977-82 (2014)).

In accordance with certain other embodiments, the binding region comprises an engineered, alternative scaffold to immunoglobulin domains. Engineered alternative scaffolds are known in the art which exhibit similar functional characteristics to immunoglobulin-derived structures, such as high-affinity and specific binding of target biomolecules, and may provide improved characteristics to certain immunoglobulin domains, such as, e.g., greater stability or reduced immunogenicity. Generally, alternative scaffolds to immunoglobulins are less than 20 kilodaltons (kDa), consist of a single polypeptide chain, lack cysteine residues, and exhibit relatively high thermodynamic stability.

For certain embodiments of the multivalent CD20-binding molecules of the present invention, the immunoglobulin-type binding region is selected from the group which includes engineered, Armadillo repeat polypeptides (ArmRPs); engineered, fibronectin-derived, $10^{th}$ fibronectin type III (10Fn3) domains (monobodies, AdNectins™, or AdNexins™); engineered, tenascin-derived, tenascin type III domains (Centryns™) engineered, ankyrin repeat motif containing polypeptides (DARPins™); engineered, low-density-lipoprotein-receptor-derived, A domains (LDLR-A) (Avimers™); lipocalins (anticalins); engineered, protease inhibitor-derived, Kunitz domains; engineered, Protein-A-derived, Z domains (Affibodies™); engineered, gamma-B crystalline-derived scaffold or engineered, ubiquitin-derived scaffolds (Affilins); Sac7d-derived polypeptides (Nanoffitins® or affitins); engineered. Fyn-derived, SH2 domains (Fynomers®); and engineered antibody mimics and any genetically manipulated counterparts of the foregoing that retains its binding functionality (Wörn A. Plückthun A, *J Mol Biol* 305: 989-1010 (2001); Xu L et al., *Chem Biol* 9: 933-42 (2002); Wikman M et al., *Protein Eng Des Sel* 17: 455-62 (2004); Binz H et al., *Nat Biotechnol* 23: 1257-68 (2005); Hey T et al., *Trends Biotechnol* 23:514-522 (2005); Holliger P, Hudson P, *Nat Biotechnol* 23: 1126-36 (2005); Gill D. Damle N, *Curr Opin Biotech* 17: 653-8 (2006); Koide A, Koide S, *Methods Mol Biol* 352: 95-109 (2007); Byla P et al., *J Biol Chem* 285: 12096 (2010); Zoller F et al., *Molecules* 16: 2467-85 (2011); Alfarano P et al., *Protein Sci* 21: 1298-314 (2012); Madhurantakam C et al., *Protein Sci* 21: 1015-28 (2012); Varadamsetty G et al., *J Mol Biol* 424: 68-87 (2012)). For example, the engineered Fn3(CD20) is an engineered, alternative scaffold CD20 binding region which exhibits high-affinity binding to CD20 expressing cells (Natarajan A et al., *Clin Cancer Res* 19: 6820-9 (2013)).

Among certain embodiments of the present invention, the immunoglobulin-type binding region is derived from a nanobody or single domain immunoglobulin-derived region $V_HH$. Generally, nanobodies are constructed from fragments of naturally occurring single, monomeric variable domain antibodies (sdAbs) of the sort found in camelids and cartilaginous fishes (Chondrichthyes). Nanobodies are engineered from these naturally occurring antibodies by truncating the single, monomeric variable domain to create smaller and more stable molecules, such as, e.g., IgNAR, $V_HH$, and $V_{NAR}$ constructs. Due to their small size, nanobodies are able to bind to antigens that are not accessible to whole antibodies. Among certain embodiments of the present invention, the immunoglobulin-type binding region is derived from a nanobody or single domain immunoglobulin-derived region $V_HH$ which exhibits high-affinity binding specifically to an extracellular part of CD20.

In accordance with certain other embodiments, the immunoglobulin-type binding region of the CD20-binding molecules of the present invention comprises an immunoglobulin-derived binding region that does not comprise an Fc region or any Fc region effector domain which retains an Fc region effector function. For certain embodiments of the multivalent CD20-binding molecules of the present invention, the multivalent CD20-binding molecule does not comprise an Fc region or Fc region effector domain which retains an Fc function (see examples of Fc functions below).

As used herein, the phrase "Fc region" refers to the fragment crystallizable region or Fc (Fragment, crystallizable region) which is a polypeptide domain present in immunoglobulins, such as, e.g., the immunoglobulin isotypes IgA, IgD, IgE, IgG, and IgM. Fc regions interact with the complement system of the immune system and/or Fc receptors present on immune cells, such as, e.g., T-cells, basophils, eosinophils, macrophagocytes (macrophages), mast cells, neutrophils, and natural killer cells (NK cells). Fc region effector functions include activating T-cells, stimulating the release of inflammatory mediators such as cytokines like TNF-alpha, initiating complement dependent cytotoxicity (CDC), antibody-dependent cytotoxicity (ADCC), eventual phagocytosis, and possible immunization effects. Fc regions may be engineered into recombinant polypeptides and proteins, such as, e.g., fusions of antigen-binding fragments and Fc regions in synthetic F(ab')2 and Fcabs.

The CD20-binding molecules of the present invention that do not comprise any Fc region or Fc region effector domain which retains an Fc region effector function may function equally well in subjects with impaired Fc-FcγR-dependent mechanisms, such as immunocompromised patients, as in other subjects, such as immunocompetent patients.

Any of the above CD20 binding regions may be used as a component of the present invention as long as the CD20 binding region component has a dissociation constant of $10^{-5}$ to $10^{-12}$ moles per liter, preferably less than 200 nM, towards an extracellular part of CD20. In certain embodiments, the multivalent CD20-binding molecule of the present invention comprises a toxin effector region derived from a proteinaceous toxin, such as, e.g., a Shiga toxin A Subunit of the Shiga toxin family.

B. Shiga Toxin Effector Region of a Multivalent CD20-Binding Molecule of the Present Invention For purposes of the present invention, the phrase "Shiga toxin effector region" refers to a polypeptide region derived from a Shiga toxin A Subunit of at least one member of the Shiga toxin family wherein the Shiga toxin effector region is capable of exhibiting at least one Shiga toxin function. Shiga toxin functions include, e.g., promoting cell entry, deforming lipid membranes, stimulating clathrin-mediated endocytosis, directing retrograde transport, directing subcellular routing, avoiding intracellular degradation, catalytically inactivating ribosomes, effectuating cytotoxicity, and effectuating cytostatic effects.

A member of the Shiga toxin family refers to any member of a family of naturally occurring protein toxins which are structurally and functionally related, notably, toxins isolated from *S. dysenteriae* and *E. coli* (Johannes L, Römer W, *Nat Rev Microbiol* 8: 105-16 (2010)). For example, the Shiga toxin family encompasses true Shiga toxin (Stx) isolated from *S. dysenteriae* serotype 1, Shiga-like toxin 1 variants (SLT1 or Stx1 or SLT-1 or Slt-I) isolated from serotypes of enterohemorrhagic *E. coli*, and Shiga-like toxin 2 variants (SLT2 or Stx2 or SLT-2) isolated from serotypes of enterohemorrhagic *E. coli*. SLT1 differs by only one residue from Stx, and both have been referred to as Verocytotoxins or Verotoxins (VTs) (O'Brien A et al., *Curr Top Microbiol Immunol* 180: 65-94 (1992)). Although SLT1 and SLT2 variants are only about 53-60% similar to each other at the amino acid sequence level, they share mechanisms of enzymatic activity and cytotoxicity common to the members of the Shiga toxin family (Johannes, *Nat Rev Microbiol* 8: 105-16 (2010)). Over 39 different Shiga toxins have been described, such as the defined subtypes Stx1a, Stx1c, Stx1d, and Stx2a-g (Scheutz F et al., *J Clin Microbiol* 50: 2951-63 (2012)). Members of the Shiga toxin family are not naturally restricted to any bacterial species because Shiga-toxin-encoding genes can spread among bacterial species via horizontal gene transfer. As an example of interspecies transfer, a Shiga toxin was discovered in a strain of *A. haemolyticus* isolated from a patient (Grotiuz G et al., *J Clin Microbiol* 44: 3838-41 (2006)). Once a Shiga toxin encoding polynucleotide enters a new subspecies or species, the Shiga toxin amino acid sequence is presumed to be capable of developing slight sequence variations due to genetic drift and/or selective pressure while still maintaining a mechanism of cytotoxicity common to members of the Shiga toxin family.

Shiga toxin effector regions of the multivalent CD20-binding molecules of the present invention comprise or consist essentially of a polypeptide derived from a Shiga toxin A Subunit dissociated from any form of its native Shiga toxin B Subunit. In addition, the multivalent CD20-binding molecules of the present invention do not comprise any polypeptide comprising or consisting essentially of a functional binding domain of a native Shiga toxin B subunit. Rather, the Shiga toxin A Subunit derived regions of the multivalent CD20-binding molecules are functionally associated with heterologous binding regions to effectuate cell targeting.

In certain embodiments, a Shiga toxin effector region of the multivalent CD20-binding molecules of the present invention may comprise or consist essentially of a full-length Shiga toxin A Subunit (e.g. SLT-1A (SEQ ID NO: 1), StxA (SEQ ID NO:2), or SLT-2A (SEQ ID NO:3)), noting that naturally occurring Shiga toxin A Subunits may comprise precursor forms containing signal sequences of about 22 amino acids at their amino-terminals which are removed to produce mature Shiga toxin A Subunits and are recognizable to the skilled worker. In other embodiments, the Shiga toxin effector region of the invention comprises or consists essentially of a truncated Shiga toxin A Subunit which is shorter than a full-length Shiga toxin A Subunit.

Shiga-like toxin 1 A Subunit truncations are catalytically active, capable of enzymatically inactivating ribosomes in vitro, and cytotoxic when expressed within a cell. The smallest Shiga toxin A Subunit fragment exhibiting full enzymatic activity was shown to be a polypeptide composed of residues 1-239 of Slt1A. Although the smallest fragment of the Shiga toxin A Subunit reported to retain substantial catalytic activity was residues 75-247 of StxA, a StxA truncation expressed de novo within a eukaryotic cell requires only up to residue 240 to reach the cytosol and exert catalytic inactivation of ribosomes.

Shiga toxin effector regions may commonly be smaller than a full-length Shiga toxin A Subunit. It is preferred that the Shiga toxin effector region maintain the polypeptide region from amino acid position 77 to 239 (SLT-1A (SEQ ID NO: 1) or StxA (SEQ ID NO:2)) or the equivalent in other A Subunits of members of the Shiga toxin family (e.g. 77 to 238 of (SEQ ID NO:3)). For example, in certain embodiments of the invention, a Shiga toxin effector region derived from SLT-1A may comprise or consist essentially of amino acids 75 to 251 of SEQ ID NO: 1, 1 to 241 of SEQ ID NO: 1, 1 to 251 of SEQ ID NO:1, or amino acids 1 to 261 of SEQ ID NO: 1. Among certain other embodiments, a Shiga toxin effector region derived from StxA may comprise or consist essentially of amino acids 75 to 251 of SEQ ID NO:2, 1 to 241 of SEQ ID NO:2, 1 to 251 of SEQ ID NO:2, or amino acids 1 to 261 of SEQ ID NO:2. Among certain other embodiments, a Shiga toxin effector region derived from SLT-2 may comprise or consist essentially of amino acids 75 to 251 of SEQ ID NO:3, 1 to 241 of SEQ ID NO:3, 1 to 251 of SEQ ID NO:3, or amino acids 1 to 261 of SEQ ID NO:3.

In certain embodiments of the multivalent CD20-binding molecules of the present invention, the Shiga toxin effector region differs from a naturally occurring Shiga toxin A Subunit by up to 1, 2, 3, 4, 5, 6, 7, 8, 9, 10, 15, 20, 25, 30, 35, 40 or more amino acid residues (but by no more than that which retains at least 85%, 90%, 95%, 99%, or more amino acid sequence identity).

In certain embodiments, the multivalent CD20-binding molecule of the present invention comprises a toxin effector region derived from a proteinaceous toxin other than a Shiga toxin(s). In certain embodiments, the multivalent CD20-binding molecule of the present invention comprises a nonfunctional Shiga toxin effector region. In certain embodiments, the multivalent CD20-binding molecule of the present invention does not comprise a Shiga toxin effector region. In certain embodiments, the multivalent CD20-binding molecule of the present invention comprises a toxin effector region, whether catalytically active or inactive, derived from a toxin(s) other than a member of the Shiga toxin family, such as, e.g., from an ABx toxin other than Shiga toxin, a ribosome inactivating protein toxin other than Shiga toxin, abrin, anthrax toxin, Aspf1, bouganin, bryodin, cholix toxin, claudin, diphtheria toxin, gelonin, heat-labile enterotoxin, mitogillin, pertussis toxin, pokeweed antiviral protein, pulchellin, *Pseudomonas* exotoxin A, restrictocin, ricin, saporin, sarcin, and subtilase cytotoxin (see e.g., WO 2015/113005; WO 2015/120058). In certain embodiments, the multivalent CD20-binding molecule of the present invention does not comprise either a toxin effector region or any polypeptide derived from a toxin.

In the above embodiments of multivalent CD20-binding molecules of the present invention, the CD20 binding regions and toxin effector polypeptide region(s) (which may be cytotoxic and/or harbor one or more mutations altering, reducing, or eliminating catalytic activity and/or cytotoxicity) may be directly linked to each other and/or suitably linked to each other via one or more linkers well known in the art and/or described herein, such as, e.g., proteinaceous linkers capable of being genetically fused between other proteinaceous components of the multivalent CD20-binding molecules of the present invention.

Optionally, a multivalent CD20-binding molecule of the present invention may further comprise a carboxy-terminal endoplasmic retention/retrieval signal motif, such as, e.g., the amino acids KDEL (SEQ ID NO:305) at the carboxy-terminus of a proteinaceous component (e.g. a protein component) of the multivalent CD20-binding molecule.

C. Linkages Connecting Components of the Multivalent CD20-Binding Molecules of the Present Invention Individual peptide, polypeptide and/or protein components of the multivalent CD20-binding molecules of the present invention, e.g., CD20 binding regions and Shiga toxin effector regions, may be suitably linked to each other via one or more linkers well known in the art and/or described herein. Protein and polypeptide components of the multivalent CD20-binding molecules of the present invention, e.g., multi-chain binding regions, may be suitably linked to each other or other polypeptide components of the multivalent CD20-binding molecules of the invention via one or more linkers well known in the art. Peptide components of the multivalent CD20-binding molecules of the present invention, e.g., antigenic peptides and KDEL family endoplasmic reticulum retention/retrieval signal motifs, may be suitably linked to another component of the invention via one or more linkers, such as a proteinaceous linker, which are well known in the art.

Suitable linkers are generally those which allow each polypeptide component of the multivalent CD20-binding molecule of the present invention to fold with a three-dimensional structure very similar to the polypeptide components produced individually without any linker or other component. Suitable linkers include single amino acids, peptides, polypeptides, and linkers lacking any of the aforementioned, such as various non-proteinaceous carbon chains, whether branched or cyclic (see e.g. Alley S et al., *Bioconjug Chem* 19: 759-65 (2008); Ducry L, Stump B, *Bioconjug Chem* 21: 5-13 (2010)).

Suitable linkers may be proteinaceous and comprise one or more amino acids, peptides, and/or polypeptides. Proteinaceous linkers are suitable for both recombinant fusion proteins and chemically linked conjugates. A proteinaceous linker typically has from about 2 to about 50 amino acid residues, such as, e.g., from about 5 to about 30 or from about 6 to about 25 amino acid residues. The length of the linker selected will depend upon a variety of factors, such as, e.g., the desired property or properties for which the linker is being selected.

Suitable linkers may be non-proteinaceous, such as, e.g. chemical linkers. Various non-proteinaceous linkers known in the art may be used to link CD20 binding regions to a Shiga toxin effector region(s), such as linkers commonly used to conjugate immunoglobulin polypeptides to heterologous polypeptides. For example, components of the multivalent CD20-binding molecules of the present invention may be linked together using the functional side chains of their amino acid residues and carbohydrate moieties such as, e.g., a carboxy, amine, sulfhydryl, carboxylic acid, carbonyl, hydroxyl, and/or cyclic ring group. For example, disulfide bonds and thioether bonds may be used to link two or more proteins. In addition, non-natural amino acid residues may be used with other functional side chains, such as ketone groups (see e.g. Axup J et al., *Proc Natl Acad Sci USA* 109: 16101-6 (2012)). Examples of non-proteinaceous chemical linkers include but are not limited to N-succinimidyl (4-iodoacetyl)-aminobenzoate, S—(N-succinimidyl) thioacetate (SATA), N-succinimidyl-oxycarbonyl-cumethyl-a-(2-pyridyldithio) toluene (SMPT), N-succinimidyl 4-(2-pyrindldithio)-pentanoate (SPP), succinimidyl 4-(N-maleimidomethyl) cyclohexane carboxylate (SMCC or MCC), sulfosuccinimidyl (4-iodoacetyl)-aminobenzoate, 4-succinimidyl-oxycarbonyl-α-(2-pyridyldithio) toluene, sulfosuccinimidyl-6-(α-methyl-α-(pyridyldithiol)-toluamido) hexanoate, N-succinimidyl-3-(-2-pyridyldithio)-proprionate (SPDP), succinimidyl 6(3(-(-2-pyridyldithio)-proprionamido) hexanoate, sulfosuccinimidyl 6(3(-(-2-pyridyldithio)-propionamido) hexanoate, maleimidocaproyl (MC), maleimidocaproyl-valine-citrulline-p-aminobenzloxycarbonyl (MC-vc-PAB), 3-maleimidobenzoic acid N-hydroxysuccinimide ester (MBS), alpha-alkyl derivatives, sulfoNHS-ATMBA (sulfosuccinimidyl N-[3-(acetylthio)-3-methylbutyryl-beta-alanine]), sulfodicholorphenol, 2-iminothiolane, 3-(2-pyridyldithio)-propionvl hydrazide, Ellman's reagent, dichlorotriazinic acid, and S-(2-thiopyridyl)-L-cysteine.

Suitable linkers, whether proteinaceous or non-proteinaceous, may include, e.g., protease sensitive, environmental redox potential sensitive, pH sensitive, acid cleavable, photocleavable, and/or heat sensitive linkers.

Proteinaceous linkers may be chosen for incorporation into embodiments of the multivalent CD20-binding molecules of the present invention which are recombinant, fusion proteins. For example, the proteinaceous components of a multivalent CD20-binding protein of the present invention may be joined by one or more linkers comprising one or more amino acids, peptides, and/or polypeptides. For recombinant, fusion, multivalent CD20-binding proteins of the present invention, linkers typically comprise about 1 to 50 amino acid residues, preferably about 5 to 30 amino acid residues. Commonly, proteinaceous linkers comprise a majority of amino acid residues with polar, uncharged, and/or charged residues, such as, e.g., threonine, proline, glutamine, glycine, and alanine. Non-limiting examples of proteinaceous linkers include alanine-serine-glycine-glycine-proline-glutamate (ASGGPE) (SEQ ID NO:353), valine-methionine (VM), alanine-methionine (AM). $AM(G_{2\ to\ 4}S)_xAM$ (SEQ ID NO:354) where G is glycine, S is serine, and x is an integer from 1 to 10.

Proteinaceous linkers may be selected based upon the properties desired. Proteinaceous linkers may be chosen by the skilled worker with specific features in mind, such as to optimize one or more of the fusion protein's folding, stability, expression, solubility, pharmacokinetic properties, pharmacodynamic properties, and/or the activity of the fused domains in the context of a fusion construct as compared to the activity of the same domain by itself. For example, proteinaceous linkers may be selected based on flexibility, rigidity, and/or cleavability. The skilled worker may use databases and linker design software tools when choosing linkers. Certain linkers may be chosen to optimize expression. Certain linkers may be chosen to promote intermolecular interactions between identical CD20-binding molecules to form homomultimers or different CD20-binding molecules to form heteromultimers (see e.g. FIG. 1B). For example, proteinaceous linkers may be selected which allow for desired non-covalent interactions between proteinaceous components of the multivalent CD20-binding molecules of the present invention, such as, e.g., interactions related to the formation of dimers and other higher order multimers (see e.g. FIG. 1B).

Flexible proteinaceous linkers are often greater than twelve amino acid residues long and rich in small, non-polar amino acid residues; polar amino acid residues; and/or hydrophilic amino acid residues, such as, e.g., glycines, serines, and threonines. Flexible proteinaceous linkers may be chosen to increase the spatial separation between components and/or to allow for intramolecular interactions between components. For example, various "GS" linkers are known to the skilled worker and are composed of multiple glycines and/or one or more serines, sometimes in repeating units, such as, e.g., $(G_xS)_n$ (SEQ ID NO:355), $(S_xG)_n$ (SEQ ID NO:356), $(GGGGS)_n$ (SEQ ID NO:357), and $(G)_n$ (SEQ ID NO:358), in which x is 1 to 6 and n is 1 to 30 (see e.g. WO 96/06641). Non-limiting examples of flexible proteinaceous linkers include GKSSGSGSESKS (SEQ ID NO:359), EGKSSGSGSESKEF (SEQ ID NO:360), GSTSGS-GKSSEGKG (SEQ ID NO:361), GSTSGS-GKSSEGSGSTKG (SEQ ID NO:362), GSTSGSGKPGS-GEGSTKG (SEQ ID NO:363). SRSSG (SEQ ID NO:364), and SGSSC (SEQ ID NO:365).

Rigid proteinaceous linkers are often stiff alpha-helical structures and rich in proline residues and/or one or more strategically placed prolines. Rigid linkers may be chosen to prevent intramolecular interactions between linked components.

Suitable linkers may be chosen to allow for in vivo separation of components, such as, e.g., due to cleavage and/or environment-specific instability. In vivo cleavable proteinaceous linkers are capable of unlinking by proteolytic processing and/or reducing environments often at a specific site within an organism or inside a certain cell type. In vivo cleavable proteinaceous linkers often comprise protease sensitive motifs and/or disulfide bonds formed by one or more cysteine pairs. In vivo cleavable proteinaceous linkers may be designed to be sensitive to proteases that exist only at certain locations in an organism, compartments within a cell, and/or become active only under certain physiological or pathological conditions (such as, e.g., involving proteases with abnormally high levels, proteases overexpressed at certain disease sites, and proteases specifically expressed by a pathogenic microorganism). For example, there are proteinaceous linkers known in the art which are cleaved by proteases present only intracellularly, proteases present only within specific cell types, and proteases present only under pathological conditions like cancer or inflammation, such as, e.g., R-x-x-R motif and AMGRSGGGCAGNRVGSSLSCG-GLNLQAM (SEQ ID NO:366).

In certain embodiments of the multivalent CD20-binding molecules of the present invention, a linker may be used which comprises one or more protease sensitive sites to provide for cleavage by a protease present within a target cell. In certain embodiments of the multivalent CD20-binding molecules of the present invention, a linker may be used which is not cleavable to reduce unwanted toxicity after administration to a vertebrate organism.

Suitable linkers may include, e.g., protease sensitive, environmental redox potential sensitive. pH sensitive, acid cleavable, photocleavable, and/or heat sensitive linkers, whether proteinaceous or non-proteinaceous.

Suitable cleavable linkers may include linkers comprising cleavable groups which are known in the art such as, e.g., linkers noted by Zarling D et al., *J Immunol* 124: 913-20 (1980); Jung S, Moroi M, *Biochem Biophys Acta* 761: 152-62 (1983); Bouizar Z et al., *Eur J Biochem* 155: 141-7 (1986); Park L et al., *J Biol Chem* 261: 205-10 (1986); Browning J, Ribolini A, *J Immunol* 143: 1859-67 (1989); Joshi S, Burrows R, *J Biol Chem* 265: 14518-25 (1990).

Suitable linkers may include pH sensitive linkers. For example, certain suitable linkers may be chosen for their instability in lower pH environments to provide for dissociation inside a subcellular compartment of a target cell. For example, linkers that comprise one or more trityl groups, derivatized trityl groups, bismaleimideothoxy propane groups, adipic acid dihydrazide groups, and/or acid labile transferrin groups, may provide for release of components of the multivalent CD20-binding molecules of the present invention, e.g. a polypeptide component, in environments with specific pH ranges. Certain linkers may be chosen which are cleaved in pH ranges corresponding to physiological pH differences between tissues, such as, e.g., the pH of tumor tissue is lower than in healthy tissues.

Photocleavable linkers are linkers that are cleaved upon exposure to electromagnetic radiation of certain wavelength ranges, such as light in the visible range. Photocleavable linkers may be used to release a component of a multivalent CD20-binding molecule of the present invention, e.g. a polypeptide component, upon exposure to light of certain wavelengths. Non-limiting examples of photocleavable linkers include a nitrobenzyl group as a photocleavable protective group for cysteine, nitrobenzyloxycarbonyl chloride cross-linkers, hydroxypropylmethacrylamide copolymer, glycine copolymer, fluorescein copolymer, and methylrhodamine copolymer. Photocleavable linkers may have particular uses in linking components to form multivalent CD20-binding molecules of the invention designed for treating diseases, disorders, and conditions that can be exposed to light using fiber optics.

In certain embodiments of the multivalent CD20-binding molecules of the present invention, a CD20 binding region is linked to a Shiga toxin effector region using any number of means known to the skilled worker, including either or both covalent and noncovalent linkages. Individual, polypeptide subcomponents of the CD20 binding regions, e.g. an immunoglobulin CDR, ABR, heavy chain variable region ($V_H$), light chain variable region ($V_L$), and/or $V_H$H region, may be suitably linked to each other via one or more linkers well known in the art and/or described herein.

In certain embodiments of the multivalent CD20-binding molecules of the present invention, the molecule comprises a CD20 binding region which is a scFv with a linker connecting a heavy chain variable ($V_H$) domain and a light chain variable ($V_L$) domain. There are numerous linkers known in the art suitable for this purpose, such as, e.g., the 15-residue $(Gly4Ser)_3$ peptide (SEQ ID NO:367). Suitable scFv linkers which may be used in forming non-covalent multivalent structures include GGS, GGGS (Gly3Ser or G3S) (SEQ ID NO:368), GGGGS (Gly4Ser or G4S) (SEQ ID NO:45), GGGGSGGG (SEQ ID NO:369), GGSGGGG (SEQ ID NO:370). GSTSGGGSGGGSGGGGSS (SEQ ID NO:371), and GSTSGSGKPGSSEGSTKG (SEQ ID NO:372).

Suitable methods for linking components of the multivalent CD20-binding molecules of the present invention may be by any method presently known in the art for accomplishing such, as long as the attachment does not substantially impede the binding capability of the CD20 binding regions, the cellular internalization of the multivalent CD20-binding molecule, and/or desired, Shiga toxin effector function(s) of the Shiga toxin effector region as measured by an appropriate assay, including by assays described herein.

D. Structural Examples of Multivalent CD20-Binding Molecules

The general structure of the multivalent CD20-binding molecules of the present invention is modular, in that various, diverse CD20 binding regions may be used with the same or different Shiga toxin effector regions to provide for cell-targeting of cytotoxicity, cytostasis, diagnostic agents, and/or exogenous material delivery to various diverse CD20-expressing cell types. It will be appreciated by the skilled worker that any two or more CD20 binding regions, each capable of binding an extracellular part of CD20, may be associated with a Shiga toxin effector region(s) to produce multivalent CD20-binding molecules of the present invention.

In certain embodiments, the multivalent CD20-binding molecules of the present invention comprise 2, 3, 4, 5, 6, 7, 8, 9, 10, 11, 12, 13, 14, 15, 16, 17, 18, 19, 20, or 22 individual CD20 binding regions.

The multivalent CD20-binding molecules of the invention may comprise various multivalent structures (see e.g. FIG. 1A and FIG. 1B). For example, multivalent structures can be created using covalent and/or non-covalent interactions to associate together various components to form a multivalent CD20-binding molecule of the present invention. In certain embodiments, the multivalent CD20-binding molecules of the present invention are multimeric complexes of two or more proteinaceous subunits, such as, e.g. dimers, trimers, tetramers, diabodies, triabodies, tetrabodies, etc.

In certain embodiments, the multivalent CD20-binding molecule of the present invention comprises two or more CD20 binding regions because two or more components of the multivalent CD20-binding molecule are chemically linked or conjugated together. For example, chemical linkers may be used to conjugate two or more CD20-binding proteins together to form a multivalent CD20-binding molecule (see e.g. Wolff E et al., *Cancer Res* 53: 2560-5 (1993); Ghetie M et al., *Proc Natl Acad Sci USA* 94: 7509-14 (1997); Ghetie M et al., *Blood* 97: 1392-8 (2001)).

Certain embodiments of the multivalent CD20-binding molecules of the present invention comprise a multimeric structure comprising two or more component molecules, which may be identical or non-identical. As used herein, the nomenclature $(X)_n$ refers to a molecule comprising or consisting of integer number (n) copies of a component (X). For example, a dimeric protein comprising two identical, monovalent, CD20-binding polypeptide subunits may be referred to as a homodimer or (CD20-binding monomer)$_2$. Another example is a mixture of multivalent proteins, each protein comprising three or more identical polypeptide "X" subunits, which is referred to herein as $(X)_{2+n}$, where "n" refers to a positive integer and the value of "2+n" representing the number of CD20 binding regions per protein of the protein molecules present, thus describing a plurality of different multivalent protein species present in a single protein composition.

Certain embodiments of the multivalent CD20-binding molecules of the present invention are multimeric, being comprised of two or more CD20-binding molecules, such as, e.g., homodimers, homotrimers, and homotetramers, and the like. For example, two or more monovalent CD20-binding polypeptides may be combined to form multivalent CD20-binding molecules of the present invention (see e.g. FIG. 1A and FIG. 1B).

In certain embodiments, the multivalent CD20-binding molecule of the present invention comprises two or more components, each comprising at least one CD20 binding region, because of a non-covalent intermolecular association(s) resulting from domain swapping between the two or more components which results in a multivalent CD20-binding molecule with a multimeric structure (see e.g. FIG. 1B). For example, protein domain swapping between immunoglobulin domains can be engineered and optimized as a mechanism of producing precise multimeric structures (see e.g. Arndt K et al., *Biochemistry* 37: 12918-26 (1998); Holliger P et al., *Proc Natl Acad Sci USA* 90: 6444-8 (1993).

The skilled worker can engineer multimeric, multivalent CD20-binding molecules of the present invention using various scFv-based polypeptide interactions, such as, e.g. scFv-based dimeric, trimeric, tetrameric complexes, etc. For example, the length of the linker in the scFv can affect the spontaneous assembly of non-covalent based, multimeric, multivalent structures. Generally, linkers of twelve amino acids or less, including the absence of any linker, promote the multimerization of polypeptides or proteins comprising scFvs into higher molecular weight species via favoring intermolecular domain swapping over intra-chain domain pairing (see e.g., Huston J et al., *Methods Enzymol* 203: 46-88 (1991); Holliger P et al., *Proc Natl Acad Sci USA* 90: 6444-8 (1993); Stemmer W et al., *Biotechniques* 14: 256-65 (1993); Whitlow M et al., *Protein Eng* 6: 989-95 (1993); Desplancq D et al., *Protein Eng* 7: 1027-33 (1994); Whitlow M et al., *Protein Eng* 7: 1017-26 (1994); Alfthan K et al., *Protein Eng* 8: 725-31 (1995); Iliades P et al., *FEBS Lett* 409: 437-41 (1997); Kortt A et al., *Biomol Eng* 18: 95-108 (2001); Todorovska A et al., *J Immunol Methods* 248: 47-66 (2001); Tomlinson I, Holliger P et al., *Methods Enzymol* 326: 461-79 (2001); Dolezal O et al., *Protein Eng* 16: 47-56 (2003)). However, scFvs with no linker at all or a linker with an exemplary length of 15 amino acid residues may multimerize (Whitlow M et al., *Protein Eng* 6: 989-95 (1993); Desplancq D et al., *Protein Eng* 7: 1027-33 (1994); Whitlow M et al., *Protein Eng* 7, 1017-26 (1994); Alfthan K et al., *Protein Eng* 8: 725-31 (1995)). The skilled worker can identify the multimeric structure(s) created and/or purified using techniques known in the art and/or described herein.

In addition, engineered structures with additional covalent bonds can be used to stabilize multimeric structures that spontaneously assemble (see e.g. Glockshuber R et al., *Biochemistry* 29: 1362-7 (1990)). For example, the introduction of cysteine residues at specific locations may be used to create disulfide stabilized structures like Cys-diabodies, scFv' multimers, $V_HH$ multimers, $V_{NAR}$ multimers, and IgNAR multimers such as, e.g., by adding the following amino acid residues: GGGGC (SEQ ID NO:373) and SGGGGC (SEQ ID NO:374) (Tai M et al., *Biochemistry* 29: 8024-30 (1990); Caron P et al., *J Exp Med* 176: 1191-5 (1992); Shopes B, *J Immunol* 148: 2918-22 (1992); Adams G et al., *Cancer Res* 53: 4026-34 (1993); McCartney J et al., *Protein Eng* 18: 301-14 (1994); Perisic O et al., *Structure* 2: 1217-26 (1994); George A et al., *Proc Natl Acad Sci USA* 92: 8358-62 (1995); Tai M et al., *Cancer Res* (Suppl) 55: 5983-9 (1995); Olafsen T et al., *Protein Eng Des Sel* 17: 21-7 (2004)). Thus, the skilled worker can create or stabilize multivalent CD20-binding molecules of the present invention using disulfide bridge(s) and/or by adding or removing cysteine residue(s) at certain positions to control the position(s) of certain disulfide bridges.

In certain embodiments, the multivalent structure of a CD20-binding molecule of the present invention comprises two or more immunoglobulin domains that binding an extracellular part of CD20. In certain embodiments, the multivalent CD20-binding molecule of the present invention may comprise or consist of a single, continuous, polypeptide chain. For example, single-chain bivalent scFvs, sometimes referred to as tandem scFvs (taFvs), single chain diabodies (scDbs), and tandem diabodies (tanDbs or Tandabs), represent multivalent binding proteins which are created from a single continuous polypeptide (see e.g. Mack M et al., *Proc Natl Acad Sci* USA 92: 7021-5 (1995); Kipriyanov S et al., *J Mol Biol* 293: 41-56 (1999); Cochlovius, B et al., *Cancer Res* 60: 4336-41 (2000); Völkel T et al., *Protein Eng* 14: 815-23 (2001); Jendreyko N et al., *J Biol Chem* 278: 47812-9 (2003); Kipriyanov S et al., *J Mol Biol* 330: 99-111 (2003); Miller K et al., *J Immunol* 170: 4854-61 (2003); Meng R et al., *Clin Cancer Res* 10: 1274-81 (2004); Schlereth B et al., *Cancer Res* 65: 2882-9 (2005); Huang T, Morrison S, *J Pharmacol Exp Ther* 316: 983-91 (2006); Liu X et al., *IntImmunopharnmacol* 6: 791-9 (2006); Shen J et al., *J Biol Chem* 281: 10706-14 (2006); Shen J et al., *Immunol Methods* 318: 65-74 (2007); Wu C et al., *Nat Biotech* 25: 1290-7 (2007); Li B et al., *Cancer Res* 68: 2400-8 (2008)).

In certain embodiments, the multivalent CD20-binding molecule of the present invention comprises both a linker(s) between two or more CD20 binding regions as well as one or more disulfide bonds between components of the CD20 binding regions, whether proximal or distal to the linker, such as a disulfide bond between two immunoglobulin regions which requires an immunoglobulin domain swapping association between those two immunoglobulin regions (see e.g. Glockshuber R et al., *Biochemistry*. 29: 1362-7 (1990)).

Alternatively, two or more polypeptide chains may be linked together using polypeptide domains which self-associate or multimerize with each other (see e.g. U.S. Pat. No. 6,329,507). For example, the addition of carboxy-terminal multimerization domains has been used to construct multivalent proteins comprising immunoglobulin domains, such as, e.g., scFvs, autonomous $V_H$ domains, $V_HH_S$, $V_{NARS}$, and IgNARs. Examples of self-associating domains known to the skilled worker include immunoglobulin constant domains (such as knobs-into-holes, electrostatic steering, and IgG/IgA strand exchange), immunoglobulin Fab chains (e.g. (Fab-scFv)$_2$ and (Fab' scFv)$_2$), immunoglobulin Fc domains (e.g. (scDiabody-Fc)$_2$, (scFv-Fc)$_2$ and scFv-Fc-scFv), immunoglobulin CHX domains, immunoglobulin CHI-3 regions, immunoglobulin $C_H3$ domains (e.g. (scDiabody-$C_H3$)$_2$, LD minibody, and Flex-minibody), immunoglobulin $C_H4$ domains, CHCL domains, amphiphilic helix bundles (e.g. scFv-HLX), helix-turn-helix domains (e.g. scFv-dHlIx), coiled-coil structures including leucine zippers and cartilage oligometric matrix proteins (e.g. scZIP), cAMP-dependent protein kinase (PKA) dimerization and docking domains (DDDs) combined with an A kinase anchor protein (AKAP) anchoring domain (AD) (also referred to as "dock-and-lock" or "DNL"), streptavidin, verotoxin B multimerization domains, tetramerization regions from p53, and bamase-barstar interaction domains (Pack P, Plückthun A, Biochemistry 31: 1579-84 (1992); Holliger P et al., Proc Natl Acad Sci USA 90: 6444-8 (1993); Kipriyanov S et al., Hum Antibodies Hybridomas 6: 93-101 (1995); de Kruif J, Logtenberg T, J Biol Chem 271: 7630-4 (1996); Hu S et al., Cancer Res 56: 3055-61 (1996); Kipriyanov S et al., Protein Eng 9: 203-11 (1996); Rheinnecker M et al., J Immunol 157: 2989-97 (1996); Tershkikh A et al., Proc Natl Acad Sci USA 94: 1663-8 (1997); Müller K et al., FEBS Lett 422: 259-64 (1998); Cloutier S et al., Mol Immunol 37: 1067-77 (2000); Li S et al., Cancer Immunol Immunother 49: 243-52 (2000); Schmiedl A et al., Protein Eng 13: 725-34 (2000); Schoonjans R et al., J Immunol 165: 7050-7 (2000); Borsi L et al., Int J Cancer 102: 75-85 (2002); Deyev S et al., Nat Biotechnol 21: 1486-92 (2003); Wong W, Scott J, Nat Rev Mol Cell Biol 5: 959-70 (2004); Zhang J et al., J Mol Biol 335: 49-56 (2004); Baillie G et al., FEBS Letters 579: 3264-70 (2005); Rossi E et al., Proc Natl Acad Sci ULSA 103: 6841-6 (2006); Simmons D et al., J Immunol Methods 315: 171-84 (2006); Braren I et al., Biotechnol Appl Biochem 47: 205-14 (2007); Chang C et al., Clin Cancer Res 13: 5586-91s (2007); Liu M et al., Biochem J 406: 237-46 (2007); Zhang J et al., Protein Expr Purif 65: 77-82 (2009); Bell A et al., Cancer Lett 289: 81-90 (2010); Iqbal U et al., Br J Pharmacol 160: 1016-28 (2010); Asano R et al., FEBS J 280: 4816-26 (2013); Gil D, Schrum A, Adv Biosci Biotechnol 4: 73-84 (2013)).

In certain embodiments, the structure of a multivalent CD20-binding molecule of the present invention is engineered from an antibody or Fab fragment. For example, multivalent CD20-binding molecules may be engineered using approaches known to the skilled worker (see e.g. Shuford W et al., Science 252: 724-7 (1991); Caron P et al., J Exp Med 176: 1191-5 (1992); Shopes B, J Immunol 148: 2918-22 (1992); Wolff E et al., Cancer Res 53: 2560-5 (1993)).

In certain embodiments of the multivalent CD20-binding molecules of the present invention, all the cell-targeting binding regions of the multivalent CD20-binding molecules are identical and/or share the same binding specificities. In such embodiments, the multivalent CD20-binding molecule of the invention is monospecific-meaning it comprises CD20 binding regions that bind with high affinity to the same extracellular CD20 target biomolecule, overlapping extracellular epitopes in the same CD20 target biomolecule, and/or the same extracellular epitope in a CD20 target biomolecule. Whether two binding regions are binding to the same extracellular part of a CD20 target biomolecule may be determined by the skilled worker with available methods, such as, e.g., empirically using competitive binding assays or predictively based on the overlap of known epitope and/or immunized peptide sequences.

In certain embodiments, the multivalent CD20-binding molecule of the present invention may comprise binding regions that bind with high affinity to non-identical epitopes, whether non-overlapping or overlapping. The multivalent CD20-binding molecules of the present invention may comprise binding regions with high binding affinity to non-overlapping epitopes. Multispecific, multivalent CD20-binding molecules of the present invention may be created using two or more different binding regions, such as, e.g., two different scFvs, $V_H H_S$, $V_{NARS}$, and/or IgNARs in diabodies, triabodies, tandem formats (including tandem di-scFv, tandem tri-scFv, and scFv-Fc tandems), single-chain diabodies (scDb), tandem Fvs, bispecific scFv (Bis-scFv), scFv2, (Fab')$_3$, tetrameric (scFv2)$_2$, scFv2-Fc, and combinations of scFvs, $V_H H_S$, $V_{NARS}$, and/or IgNARs with different specificities (Adams G et al., Cancer Res 53: 4026-34 (1993); Mallender W et al., J Biol Chem 269: 199-206 (1994); Todorovska A et al., J Immunol Methods 248: 47-66 (2001); Kom T et al., J Gene Med 6: 642-51 (2004); Lu D et al., J Biol Chem 280: 19665-72 (2005); Schneider M et al., Eur J Immunol 35: 987-95 (2005); Wittel U et al., Nucl Med Biol 32: 157-64 (2005); Semenyuk E et al., Biochimie 89: 31-8 (2007)).

In certain embodiments, the multivalent CD20-binding molecule of the present invention may comprise a single, continuous polypeptide component which is multimerized with itself or another protein to form a multimeric structure. For example, single-chain bivalent scFvs, sometimes referred to as tandem scFvs (taFvs), single chain diabodies (scDbs), and tandem diabodies (tanDbs or Tandabs), can be expressed as single continuous polypeptide chain (Mack M et al., Proc Natl Acad Sci USA 92: 7021-5 (1995); Kipriyanov S et al., J Mol Biol 293: 41-56 (1999); Cochlovius, B et al., Cancer Res 60: 4336-41 (2000); Völkel T et al., Protein Eng 14: 815-23 (2001); Kipriyanov S et al., J Mol Biol 330: 99-111 (2003); Schlereth B et al., Cancer Res 65: 2882-9 (2005)). These multivalent structures may be engineered to multimerize into higher-order, higher-valence structures, such as, e.g. a tetravalent F(ab')$_2$, (taFv)$_2$, and (scDb)$_2$ structures (see Todorovska A et al., J Immunol Methods 248: 47-66 (2001)).

Structures comprising two scFvs linked by non-covalent interactions due to the intermolecular pairing of variable regions are known to the skilled worker, such as, e.g., diabodies, mini-antibodies, and bivalent mini-antibodies, all of which may be either monospecific or bispecific (Holliger, P et al., Proc Natl Acad Sci USA 90: 6444-8 (1993); Pack P et al., Biotechnology (NY) 11: 1217-7 (1993); Tai M et al., Cancer Res (Suppl) 55: 5983-9 (1995); Atwell J et al., Mol Immunol 33: 1301-12 (1996); Rheinnecker M et al., J Immunol 157: 2989-97 (1996); Schier R et al., J Mol Biol 255: 28-43 (1996); Adams G et al., Br J Cancer 77: 1405-12 (1998); Todorovska A et al., J Immunol Methods 248: 47-66 (2001); Buihler P et al., Cancer Immunol Immunother 57: 43-52 (2008)). Numerous scFv monomers have been observed to naturally form multimers or oligomers (e.g. diabodies, triabodies, and tetrabodies) due to self-association, with the majority form being dimeric for scFv structures comprising linkers of 3-12 amino acid residues (Essig N et al., J Mol Biol 234: 897-901 (1993); Griffiths A et al., EMBO J 12: 725-34 (1993); Holliger P et al., Proc Natl Acad Sci USA 90: 6444-8 (1993); Whitlow M et al., Protein Eng 6: 989-95 (1993); Desplancq D et al., Protein Eng 7: 1027-33 (1994); Whitlow M et al., Protein Eng 7, 1017-26 (1994); Kortt A et al., Protein Eng 10: 423-33 (1997); Arndt K et al., Biochemistry 37: 12918-26 (1998); Atwell J et al., Protein Eng 12: 597-604 (1999)).

In general, scFv structures with a relatively short linker of five to ten amino acid residues or less have a greater propensity for homo-dimerization (Arndt K et al., Biochemistry 37: 12918-26 (1988); Holliger P et al., Proc Natl Acad Sci USA 90: 6444-8 (1993); Perisic O et al., *Structure* 2: 1217-26 (1994); Atwell J et al., *Mol Immunol* 33: 1301-12 (1996); Iliades P et al., *FEBS Lett* 409: 437-41 (1997); Kortt A et al., *Protein Eng* 10: 423-33 (1997); Metzger D et al., *Protein Eng* 10: 423-33 (1997); Pei X et al., *Proc Natl Acad Sci USA* 94: 9637-42 (1997); Atwell J et al., *Protein Eng* 12: 597-604 (1999); Denton G et al., *Cancer Immunol Immunother* 48: 29-38 (1999); Le Gall F et al., *FEBS Lett* 453: 164-8 (1999); Atwell J et al., *Protein Eng* 12: 597-604 (1999); Dolezal, O et al., *Protein Eng* 13: 565-74 (2000); Nielsen U et al., *Cancer Res* 60: 6434-40 (2000); Todorovska A et al., *J Immunol Methods* 248: 47-66 (2001); Wu A et al., *Protein Eng* 14: 1025-33 (2001); Arndt M et al., *FEBSLett* 578: 257-61 (2004); Le Gall F et al., *JImmunol Methods* 285: 111-27 (2004)). In contrast, scFvs with linkers comprising at least 12 amino acid residues predominantly form monomers with only a minority fraction undergoing spontaneous multimerization (Nielsen U et al., *Cancer Res* 60: 6434-40 (2000); Denton G et al., *Cancer Immunol Immunother* 48: 29-38 (1999); Kortt A et al., *Biomol Eng* 18: 95-108 (2001); Völkel T et al., *Protein Eng* 14: 815-23 (2001)).

The use of linkers of three amino acid residues or fewer may promote multimerization to higher order structures larger than dimeric forms. If an scFv has a linker of less than 3 residues, then trimerization may be favored (Iliades P et al., *FEBS Lett* 409: 437-41 (1997)); Kortt A et al., *Biomol Eng* 18: 95-108 (2001); Todorovska A et al., *J Immunol Methods* 248: 47-66 (2001); Arndt M et al., *FEBS Lett* 578: 257-61 (2004)). Furthermore, scFvs with very short linkers, e.g., linkers of 2 amino acid residues or less, often form trimers and/or mixtures of trimers and tetramers (Pei X et al., *Proc Natl Acad Sci USA* 94: 9637-42 (1997); Hudson P, Kortt A, *J Immunol Methods* 231: 177-89 (1999); Dolezal O et al., *Protein Eng* 13: 565-74 (2000); Power B et al., *Protein Si* 12: 734-47 (2003); Le Gall F et al., *J Immunol Methods* 285: 111-27 (2004)). In certain arrangements with short linkers, tetramers may be favored (Dolezal O et al., *Protein Eng* 13: 565-74 (2003); Arndt M et al., *FEBS Lett* 578: 257-61 (2004)). Multimeric structures can be formed by scFvs lacking any linker, i.e. having a linker length of zero amino acid residues. For example, the direct linkage of variable domains with $V_L$ before $V_H$ may favor the formation of tetrabodies (Iliades P et al., *FEBS Lett* 409: 437-41 (1997)) whereas $V_H$ before $V_L$ may favor trimers (Kortt A et al., *Protein Eng* 10: 423-33 (1997)).

In addition to the linker length, the orientation of the variable domains may affect multimerization characteristics (Huston J et al., *Proc Natl Acad Sci USA* 85, 5879-83 (1988); Padlan E, *Mol Immunol* 31: 169-217 (1994); Kortt A et al., *Protein Eng* 10: 423-33 (1997); Dolezal, O et al., *Protein Eng* 13: 565-74 (2000); Carmichael J et al., *J Mol Biol* 326: 341-51 (2003); Arndt M et al., *FEBS Lett* 578: 257-61 (2004)). It has been suggested that the $V_L$-$V_H$ Orientation exhibits a greater tendency to form higher molecular weight oligomers than does the reverse orientation because the $V_L$-$V_H$ orientation is more constrained (Kortt A et al., *Protein Eng* 10: 423-33 (1997); Dolezal, O et al., *Protein Eng* 13: 565-74 (2000); Plückthun A, Pack P, *Immunotechnology* 3: 83-105 (1997)).

The same linker has shown variability in its effect on scFv multimerization depending on the $V_H$ and $V_L$ orientation, such as, e.g., affecting the relative proportions of dimeric to trimeric forms (Le Gall F et al., *FEBS Lett* 453: 164-8 (1999); Arndt M et al., *FEBS Lett* 578: 257-61 (2004); Le Gall F et al., *J Immunol Methods* 285: 111-27 (2004)).

Camelid $V_H$H immunoglobulin domains have been multimerized using particular hinges and covalently linked multi $V_H$H chains (tandem) (Fraile S et al., *Mol Microbiol* 53: 1109-21 (2004); Zhang J et al., *J Mol Biol* 335: 49-56 (2004)). Immunoglobulin domains from Chondrichthyes, such as IgNARs, have been multimerized using certain hinges or cysteine-mediated disulfide bond stabilization (see e.g. Simmons et al., *J Immunol Methods* 315: 171-84 (2006)).

Thus, the generation of multivalent CD20-binding molecules comprising various immunoglobulin domains may be controlled by molecular engineering strategies which are either covalent or non-covalent, such as, e.g., covalent strategies involving single-chain tandem arrangements, covalent strategies involving cysteine-mediated, disulfide bond stabilized multimers, and/or non-covalent strategies involving dimerization domains, linker choice, and/or variable domain order. Multiple strategies (e.g., linker-related non-covalent multimerization and covalent disulfide bond stabilization) may be combined when creating structures that are multivalent CD20-binding molecules of the present invention (see e.g. Lu D et al., *J Immunol Methods* 279: 219-32 (2003)).

For the purposes of the present invention, the specific order or orientation is not fixed for the toxin effector region(s) and the two or more CD20 binding regions in relation to each other or the entire multivalent CD20-binding molecule of the present invention. The components of the multivalent CD20-binding molecules of the present invention may be arranged in any order provided that the desired activities of the CD20 binding regions and the toxin effector region(s) are not eliminated. Desired activities include providing the multivalent CD20-binding molecule with the ability to, e.g., bind CD20-expressing cells; rapidly induce cellular internalization; cause efficient internalization; intracellularly route to a desired subcellular compartment(s); cause cytostasis; cause cytotoxicity; selectively kill CD20-expressing cells; deliver exogenous materials into the interior of a cell; diagnosis a disease, disorder, or condition; and/or treat a disease, disorder, or condition in a patient in need thereof.

E. Determining the Relative Proportion(s) of a Multivalent CD20-Binding Molecule to One or More Other CD20-Binding Molecule(s) Present in a Composition of the Present Invention The ratios, percentages, and/or relative proportions of different molecular species within a composition of the present invention may be determined by the skilled worker using a technique well-known in the art and/or described herein, such as, e.g., chromatographic, electrophoretic, electrochromatographic, capillary, centrifugation, isoelectric focusing, and microfluidic techniques for analyzing proteinaceous molecules. For example, the size and/or intensity of different “peaks” or “bands” resulting from subjecting a protein sample to any of the aforementioned methods can be used to calculate the relative ratio of different-sized CD20-binding molecules within a composition.

Because all compositions of the present invention comprise at least one multivalent CD20-binding molecule which comprises at least one proteinaceous component, the skilled worker may use techniques known in the art to determine relative proportions of proteinaceous molecules. For example, the proportions of different proteinaceous molecular species within a composition of the present invention may be determined by amino acid analysis/amino acid quantification techniques known to the skilled worker (see e.g. Bio-Synthesis, Inc., Lewisville, Tex., U.S.). In another example, the relative proportions of different-sized proteinaceous molecules within a composition of the present invention may be determined using chromatographic, electrophoretic, electrochromatographic, and/or density-gradient ultra-centrifugation techniques known to the skilled worker and/or described herein, such as, e.g., via gel electrophoresis and densitometry analysis of the results.

The skilled worker may use software methods known in the art and/or described herein to perform analysis of data obtained from, inter alia, amino acid quantification, chromatographic, electrophoretic, electrochromatographic, and density-gradient ultra-centrifugation assays to determine the proportions of different molecular species present in a composition of the present invention. For example, the skilled worker may use software methods known in the art to perform peak-integration analysis of chromatographic, electrophoretic, and/or electrochromatographic data, such as, e.g., size-exclusion chromatographic (SEC) data, in order to compare the relative proportion(s) of different molecular species present in a composition of the present invention. Through the use of molecular-size migration standards (e.g., gel filtration and ion-exchange standards) and knowledge of possible molecular species present in a composition of the present invention, the size of molecular species in a peak may be estimated and the identity of the molecular species in a peak may be inferred. Alternatively or in addition, complimentary methods (e.g. sodium dodecyl sulfate, polyacrylamide gel electrophoresis(SDS-PAGE) or mass spectroscopy) known to the skilled worker and/or described herein may be used to determine the molecule(s) composed in certain peaks.

Peak integration calculations can be used to determine various curve characteristics including peak areas, retention times, peak heights, peak widths, and percentage of peak area to total peak areas. For any peak integration analysis, a baseline may be calculated first, such as, e.g., using an automatic calculation combined with a blank curve (e.g. data collected from a solvent or mobile phase blank run), blank curve subtraction, or zero baseline. Certain settings, such as, e.g., structure width, baseline noise parameter(s), baseline slope limit or threshold slope setting, maximum baseline limit, and/or minimum distance between data points, may be adjusted in certain situations. For any chromatographic, electrophoretic, and/or electrochromatographic data analysis, the scope of analysis can be limited to certain retention time ranges (e.g., to avoid the column inclusion volume and/or to avoid data from retention times beyond the exclusion limit). User editing of peak window limits and rejection of peak assignments may be performed where appropriate or via changing settings like minimum area and/or minimum height.

Amino acid quantification, chromatographic, electrophoretic, electrochromatographic, and/or density-gradient ultra-centrifugation methods known to the skilled worker and/or described herein may be used to determine: 1) relative concentration ratios of different CD20-binding molecules within a composition of the present invention, 2) relative molar ratios of different CD20-binding molecules within a composition of the present invention, 3) relative mass ratios of different CD20-binding molecules within a composition of the present invention, and/or 4) relative molal concentration ratios of different CD20-binding molecules within a composition of the present invention. For example, the relative proportion of multivalent CD20-binding molecule in a composition of the present invention can be expressed as a percentage (whether of concentrations, molarities, masses, or molalities) calculated from the total multivalent CD20-binding molecule divided by the total proteinaceous species multiplied by 100. Alternatively, the relative proportion of multivalent CD20-binding molecule in a composition of the present invention can be expressed as a ratio of concentrations, molarities, masses, or molalities using the measurement of a total multivalent CD20-binding molecule species to the measurement of another molecular species regardless of it being a different multivalent CD20-binding molecule species or a non-CD20-binding molecular species.

In the Examples below, fast protein liquid chromatography size exclusion (FPLC-SEC) and high performance liquid chromatography size exclusion (HPLC-SEC) analyses of CD20-binding molecule compositions were used to determine the relative amounts of multivalent CD20-binding molecules of different sizes present in a composition as well as the relative amounts of multivalent CD20-binding molecules to other molecules like monovalent CD20-binding molecules, e.g., ratios between monovalent, divalent, and higher-valence CD20-binding proteinaceous species present in the compositions were determined.

One example of a method known in the art with which the skilled worker may use to determine ratios and/or percentages of different molecular species within a composition of the present invention is dynamic light scattering or photon correlation spectroscopy (see e.g., Lamkemeyer T et al., *FEBS J* 273: 3393-410 (2006); Rousselot M et al., *FEBS J* 273: 4055-71 (2006); Bruneaux M et al., *Curr Protein Pept Sci* 9: 15-80 (2008)).

Another example of a method known in the art with which the skilled worker may use to determine ratios and/or percentages of different molecular species within a composition of the present invention is the Protein 230 Assay using the Agilent Bioanalyzer running Agilent 2100 Expert software (Agilent Technologies, Inc., Santa Clara. Calif., U.S.). The Protein 230 Assay can be used to estimate the quantity, molecular weight, and purity of a multivalent CD20-binding molecule composition of the present invention. The Protein 230 Assay produces data presented as gel-like images with "bands" and/or electrophenograms with "peaks." A standard ladder of known marker sizes may be used to create standard gel-like and electrophenogram profiles for each analysis. Then the migration behavior of a sample in the assay is used to predict, inter alia, its size. Laser-induced fluorescence intensity may be used to estimate protein quantity in a sample, individual band, and/or peak.

In certain embodiments, the multivalent CD20-binding molecule composition of the present invention comprises a multivalent CD20-binding molecule of the present invention, wherein the composition comprises a ratio of monovalent CD20-binding protein concentration to total CD20-binding molecule concentration of less than one to three; and wherein each monovalent CD20-binding protein comprises only one CD20 binding region capable of specifically binding an extracellular part of a CD20 and comprises at least one Shiga toxin effector polypeptide. In certain further embodiments, the multivalent CD20-binding molecule composition comprises the ratio of monovalent CD20-binding protein concentration to total CD20-binding molecule concentration of less than the ratio selected from the following: 1:5, 1:6, 1:7, 1:8, 1:9, 1:10, and 1:11. In certain embodiments, the multivalent CD20-binding molecule composition of the present invention comprises a ratio of multivalent CD20-binding protein concentration to total CD20-binding protein concentration of more than two to three.

In certain embodiments, the multivalent CD20-binding molecule composition of the present invention comprises a ratio of relatively large valence CD20-binding protein concentration to total CD20-binding protein concentration of less than the ratio selected from the following: 1:4, 1:7, 1:11, 1:21, 1:41, 1:71, 1:111, and 1:161; wherein each relatively large-valence CD20-binding protein comprises three or more CD20 binding regions capable of specifically binding an extracellular part of a CD20 and comprises at least one Shiga toxin effector polypeptide.

In certain embodiments, the multivalent CD20-binding molecule composition of the present invention comprises a ratio of bivalent CD20-binding molecule concentration to total CD20-binding molecule concentration of more than a ratio selected from the following: 1:2, 2:3, 3:4, 4:5, 5:6, 7:8, 8:9, 9:10, 10:11, 11:12, 12:13, 13:14, and 14:15; wherein each bivalent CD20-binding molecule comprises (1) only two CD20 binding regions capable of specifically binding an extracellular part of a CD20 and (2) one or more Shiga toxin effector polypeptides.

In certain embodiments, the multivalent CD20-binding molecule composition of the present invention comprises a multivalent CD20-binding molecule of the present invention, wherein the composition comprises a ratio of monovalent CD20-binding molecule mass to total CD20-binding molecule mass of less than one to three; and wherein each monovalent CD20-binding molecule comprises only one CD20 binding region capable of specifically binding an extracellular part of a CD20 and comprises at least one Shiga toxin effector polypeptide. In certain further embodiments, the multivalent CD20-binding molecule composition comprises the ratio of monovalent CD20-binding molecule mass to total CD20-binding protein mass of less than the ratio selected from the following: 1:5, 1:6, 1:7, 1:8, 1:9, 1:10, and 1:11. In certain embodiments, the multivalent CD20-binding molecule composition of the present invention comprises a ratio of multivalent CD20-binding molecule mass to total CD20-binding molecule mass of more than two to three.

In certain embodiments, the multivalent CD20-binding molecule composition of the present invention comprises a ratio of relatively large valence CD20-binding molecule mass to total CD20-binding molecule mass of less than the ratio selected from the following: 1:4, 1:7, 1:11, 1:21, 1:41, 1:71, 1:111, and 1:161; wherein each relatively large-valence CD20-binding molecule comprises three or more CD20 binding regions capable of specifically binding an extracellular part of a CD20 and comprises at least one Shiga toxin effector polypeptide.

In certain embodiments, the multivalent CD20-binding molecule composition of the present invention comprises a ratio of bivalent CD20-binding molecule mass to total CD20-binding molecule mass of more than a ratio selected from the following: 1:2, 2:3, 3:4, 4:5, 5:6, 7:8, 8:9, 9:10, 10:11, 11:12, 12:13, 13:14, and 14:15; wherein each bivalent CD20-binding molecule comprises (1) only two CD20 binding regions capable of specifically binding an extracellular part of a CD20 and (2) one or more Shiga toxin effector polypeptides.

In certain embodiments, the multivalent CD20-binding molecule composition of the present invention comprises a multivalent CD20-binding molecule of the present invention, wherein the composition comprises a ratio of monovalent CD20-binding molecule molarity to total CD20-binding molecule molarity of less than one to 1.5, and wherein each monovalent CD20-binding molecule comprises only one CD20 binding region capable of specifically binding an extracellular part of a CD20 and comprises at least one Shiga toxin effector polypeptide. In certain further embodiments, the multivalent CD20-binding molecule composition comprises the ratio of monovalent CD20-binding molecule molarity to total CD20-binding protein molarity of less than the ratio selected from the following: 1:2, 1:3, 1:4, 1:5, 1:6, 1:7, and 1:8. In certain embodiments, the multivalent CD20-binding molecule composition of the present invention comprises a ratio of multivalent CD20-binding molecule molarity to total CD20-binding molecule molarity of more than one to 1.5.

In certain embodiments, the multivalent CD20-binding molecule composition of the present invention comprises a ratio of relatively large valence CD20-binding molecule molarity to total CD20-binding molecule molarity of less than the ratio selected from the following: 1:2, 1:3.5, 1:5, 1:11, 1:21, 1:36, 1:55, and 1:59; wherein each relatively large-valence CD20-binding molecule comprises three or more CD20 binding regions capable of specifically binding an extracellular part of a CD20 and comprises at least one Shiga toxin effector polypeptide.

In certain embodiments, the multivalent CD20-binding molecule composition of the present invention comprises a ratio of bivalent CD20-binding molecule molarity to total CD20-binding molecule molarity of more than a ratio selected from the following: 1:1.5, 2:3, 3:4, 4:5, 5:6, 7:8, 8:9, 9:10, 10:11, 11:12, 12:13, 13:14, and 14:15; wherein each bivalent CD20-binding molecule comprises (1) only two CD20 binding regions capable of specifically binding an extracellular part of a CD20 and (2) one or more Shiga toxin effector polypeptides.

In certain embodiments, the multivalent CD20-binding molecule composition of the present invention comprises a multivalent CD20-binding molecule of the present invention, wherein the composition comprises a ratio of monovalent CD20-binding molecule molality to total CD20-binding molecule molality of less than one to 1.5; and wherein each monovalent CD20-binding molecule comprises only one CD20 binding region capable of specifically binding an extracellular part of a CD20 and comprises at least one Shiga toxin effector polypeptide. In certain further embodiments, the multivalent CD20-binding molecule composition comprises the ratio of monovalent CD20-binding molecule molality to total CD20-binding protein molality of less than the ratio selected from the following: 1:2, 1:3, 1:4, 1:5, 1:6, 1:7, and 1:8. In certain embodiments, the multivalent CD20-binding molecule composition of the present invention comprises a ratio of multivalent CD20-binding molecule molality to total CD20-binding molecule molality of more than one to 1.5.

In certain embodiments, the multivalent CD20-binding molecule composition of the present invention comprises a ratio of relatively large valence CD20-binding molecule molality to total CD20-binding molecule molality of less than the ratio selected from the following: 1:2, 1:3.5, 1:5, 1:11, 1:21, 1:36, 1:55, and 1:59; wherein each relatively large-valence CD20-binding molecule comprises three or more CD20 binding regions capable of specifically binding an extracellular part of a CD20 and comprises at least one Shiga toxin effector polypeptide.

In certain embodiments, the multivalent CD20-binding molecule composition of the present invention comprises a ratio of bivalent CD20-binding molecule molality to total CD20-binding molecule molality of more than a ratio selected from the following: 1:1.5, 2:3, 3:4, 4:5, 5:6, 7:8, 8:9, 9:10, 10:11, 11:12, 12:13, 13:14, and 14:15; wherein each bivalent CD20-binding molecule comprises (1) only two CD20 binding regions capable of specifically binding an extracellular part of a CD20 and (2) one or more Shiga toxin effector polypeptides.

F. Molecular Stability, Composition Stability, Controlling Multimerization, and Minimizing Aggregation For certain applications, the stability of the relative proportion of multivalent CD20-binding molecule(s) to total CD20-binding molecules in a composition of the present invention may be important to the composition's effectiveness. For example in certain medical applications, the stability of the relative proportions of multivalent CD20-binding molecule(s) of the present invention to monovalent CD20-binding molecule(s) may be important. In certain applications, the stability of the relative proportions of bivalent CD20-binding molecules to higher-valency CD20-binding molecules may be important. In certain applications, the stability of the relative proportion of bivalent CD20-binding molecules to non-bivalent CD20-binding molecules may be important.

For certain embodiments, one or more steps of controlled multimerization of some or all of the components of a multivalent CD20-binding molecule of the present invention may be used to produce a composition of the present invention.

For certain applications, the minimization or otherwise controlling of unwanted aggregation and/or multimerization of CD20-binding molecules may be important for certain compositions of the present invention. For example with certain proteinaceous therapeutics, the aggregation and/or multimerization of the therapeutic molecule can in certain situations increase the risk for unwanted immune responses in recipients of the proteinaceous therapeutic. In particular, CD20-binding molecule aggregation and/or multimerization to higher molecular weight complexes may increase the risk of unwanted immune responses after administration of certain CD20-binding molecule compositions to certain recipients. In addition, misfolded proteins and degraded protein products can exhibit increased immunogenicity as compared to their properly folded counterparts.

For all of these reasons and depending on the specific application, the skilled worker will appreciate whether there is a need to consider 1) the stability of multivalent CD20-binding molecules of the compositions of the present invention and 2) the stability of the ratios of different CD20-binding molecules present in compositions of the present invention. For example, in certain embodiments, the multivalent CD20-binding molecule of the present invention and compositions thereof are the result of controlled multimerization and/or certain purification steps. Similarly, in certain embodiments, the multivalent CD20-binding molecule of the present invention will be engineered to eliminate or reduce certain multimerization possibilities. In certain embodiments, the multivalent CD20-binding molecule of the present invention will be designed to avoid the formation of unwanted aggregates, such as, e.g., under certain storage conditions like in an aqueous solution at 8, 4, 2, −4, −10, −20, or −25° C.

For certain applications of the compositions of the present invention, it may be desirable to minimize in the composition of the present invention the amount of: 1) high molecular weight, multivalent CD20-binding molecules (e.g. molecules greater than 175, 180, 190, 200, or 250 kDa or larger); 2) greatly multivalent CD20-binding molecules (i.e. molecules comprising five or more CD20 binding regions); 3) multimers of CD20-binding molecules which are high molecular weight, multivalent CD20-binding molecules representing #1 and/or greatly multivalent CD20-binding molecules representing #2 (e.g. certain, large, noncovalent multimers of CD20-binding molecules); 3) misfolded proteins (e.g., misfolded CD20-binding proteins or protein components thereof); and/or 4) degradation products (e.g. unwanted protein fragments of a proteinaceous component of a multivalent CD20-binding molecule, such as, e.g., a polypeptide fragment of a Shiga toxin effector region or CD20 binding region). For example, a rationale to minimize the amount of any of the types of molecules listed as #1-#4 above might be for medical applications where the presence of a certain amounts of these molecules might increase the potential for unwanted antigenic and/or immunogenic reactions in a recipient of a compositions of the present invention, such as, e.g., by the presence of these molecules revealing new epitopes or by forming repetitive motifs more readily identified by a recipient's immune system as foreign.

The skilled worker may use routine methods to assess multimerization states of the multivalent CD20-binding molecules of the present invention and/or molecules present in the compositions of the present invention. The skilled worker may use routine methods to minimize the presence or relative proportion of CD20-binding molecule aggregates, high molecular weight CD20-binding protein multimers, misfolded CD20-binding proteins, and CD20-binding protein degradation products in the compositions of the present invention.

In certain embodiments of the compositions of the present invention, the relative proportion of bivalent, trivalent, and/or tetravalent forms of multivalent CD20-binding molecule(s) is maximized, such as by further purifying away from monovalent CD20-binding protein(s), higher molecular weight CD20-binding molecule(s), misfolded CD20-binding protein(s), and/or protein degradation product(s).

The skilled worker may use routine methods to create a multivalent CD20-binding molecule of the present invention, and compositions thereof. The skilled worker may use routine methods to stabilize the relative proportions of certain multivalent CD20-binding molecules to other molecules in a composition of the present invention, including the proportions of different multimeric forms of CD20-binding molecules, such as, e.g., the proportions of covalently linked, multimeric, multivalent CD20-binding molecules to non-covalently linked, multimeric, multivalent CD20-binding molecules (see e.g. Gil D, Schrum A, *Adv Biosci Biotechnol* 4: 73-84 (2013); WO2005000898). For example, the multimerization of CD20-binding molecule(s) in compositions of the present invention may be controlled and/or minimized, such as, e.g., by choosing certain linkers to link and/or associate different components and/or subunits of the CD20-binding molecule(s) present in the compositions of the present invention. For example, in certain embodiments, the CD20 binding region of the multivalent CD20-binding molecule of the present invention is engineered to minimize the formation of unwanted, intermolecular associations, multimers, and/or aggregates, such as, e.g., by using disulfide-stabilized scFvs, Fv fragments, or Fabs (see e.g. Reiter Y et al., *J Biol Chem* 269: 18327-31 (1994); Kuan C, Pastan I, *Biochemistry* 35: 2872-7 (1996); Almog O et al., *Proteins* 31: 128-38 (1998); Schoonjans R et al., *J Immunol* 165: 7050-7 (2000); Olafsen T et al., *Protein Eng Des Sel* 17: 21-7 (2004); Gil D, Schrum A, *Adv Biosci Biotechnol* 4: 73-84 (2013); U.S. 20120283418); base loop connections (see e.g. Brinkmann U et al., *J Mol Biol* 268: 107-17 (1997)); and/or other modifications, such as the addition of charged resides, glycans, and/or immunoglobulin-domain truncations (see e.g. Gong R et al., *Mol Pharm* 10: 2642-52 (2013); Lee C et al., *Trends Biotechnol* 31: 612-20 (2013)).

In certain embodiments of the present invention, the multivalent CD20-binding molecule of the present invention comprises a CD20 binding region which is an scFv engineered not to aggregate, such as, e.g., by using a shorter linker (typically less than twelve amino acid residues) and/or disulfide-stabilized linker that links the heavy and light chain regions of the scFv (see e.g., Brinkmann U et al., *Proc Natl Acad Sci USA* 90: 7538-42 (1993); Whitlow M et al., *Protein Engineering* 6: 989-95 (1993); Reiter Y et al., *Biochemistry* 33: 5451-9 (1994); Gong R et al., *Molecular Pharmaceutics* 10: 2642-52 (2013)).

In certain embodiments, the multivalent CD20-binding molecule composition of the present invention minimizes the proportion relative to other CD20-binding molecules of certain, multivalent CD20-binding molecule(s) with a valence greater than two. In certain embodiments, the multivalent CD20-binding molecule composition of the present invention comprises a relative percentage of multivalent CD20-binding molecules with a valence of greater than four which is 15%, 10%, 7.5%, 5%, 2%, 1%, or less of the total CD20-binding molecules in the composition. In certain embodiments, a multivalent CD20-binding molecule composition of the present invention comprises a relative percentage of CD20-binding molecules with a valence of greater than three to other CD20-binding molecules which is 15%, 10%, 7.5%, 5%, 2%, 1%, or less of the total CD20-binding molecules in the composition. In certain embodiments, a multivalent CD20-binding molecule composition of the present invention comprises a percentage of CD20-binding molecules with a valence greater than two which is 15%, 10%, 7.5%, 5%, 2%, 1%, or less of the total CD20-binding molecules in the composition.

In certain embodiments, the composition of the present invention maximizes the relative proportion of multivalent CD20-binding molecule(s) with exactly two CD20 binding regions to total CD20-binding molecules. Thus, in certain embodiments, a composition of the present invention comprises a proportion of CD20-binding molecule with only two CD20 binding regions which is 80%, 85%. 88%, 90%, 92%, 93%, or more of the total CD20-binding molecules in the composition.

For certain applications, it may be desirable to maintain stability (e.g., the stability of associations and/or linkages between components and/or subunits of the multivalent CD20-binding molecules) of multivalent CD20-binding molecule(s) in a multivalent composition of the present invention, such as, e.g., to minimize degradation during formulation, storage (such as, e.g., storage in an aqueous solution at 8, 4, 2, −4, −10, −20, or −25° C.), and/or after administration to a recipient. The skilled worker may use well known methods to minimize component or subunit separation for a multivalent CD20-binding molecule of the present invention, such as, e.g., by using high-stability linkages between the Shiga toxin effector polypeptide(s) and binding region(s) and/or by engineering disulfide linkages between components, regions, or sub-regions of a multivalent CD20-binding molecule or between monovalent CD20-binding proteins to generate multivalent CD20-binding protein(s) of the present invention (see e.g. Gil D, Schrum A. *Adv Biosci Biotechnol* 4: 73-84 (2013)). The skilled worker may use the addition or maintenance of intermolecular disulfide bonds to stabilize certain CD20 binding regions of the multivalent CD20-binding molecules of the present invention (see e.g. Glockshuber R et al., *Biochemistry* 29: 1362-7 (1990); Stanfield R et al., *Science* 305: 1770-3 (2004); Hagihara Y et al., *J Biol Chem* 282: 36489-95 (2007); Chan P et al., *Biochemistry* 47: 11041-54 (2008); Saerens D et al., *J Mol Biol* 478-88 (2008); Hussack G et al., *PLoS One* 6: e28218 (2011); Govaert J et al., *J Biol Chem* 287: 1970-9 (2012); Kim D et al., *Protein Eng Des Sel* 25: 581-9 (2012); Gil D, Schrum A, *Adv Biosci Biotechnol* 4: 73-84 (2013); McConnell A et al., *Protein Eng Des Sel* 25: 581-9 (2013); Feige M et al., *Proc Natl Acad Sci USA* 111: 8155-60 (2014); Hagihara Y, Saerens D, *Biochim Biophys Acta* 1844: 2016-2023 (2014); Kim D et al., *Mabs* 6: 219-35 (2014)).

In certain embodiments, the multivalent CD20-binding molecule of the present invention comprises a CD20 binding region(s) which comprises an immunoglobulin domain and/or Ig-fold structure having an intra-domain disulfide bond, such as, e.g., the disulfide bond found natively between the B and F β strands of certain immunoglobulins and/or a disulfide bond between their heavy and light chains of or derived from an immunoglobulin. However, in certain embodiments of the multivalent CD20-binding molecules of the present invention, the molecules are very stable even though they do not comprise an intra-domain disulfide bond or any intra-domain disulfide bond within one or more CD20 binding regions (see e.g. Proba K et al., *Biochemistry* 37: 13120-7 (1998); Wörn A, Plückthun A, *Biochemistry* 37: 13120-7 (1998); Wörn A, Plückthun A, *FEBS Lett* 427: 357-61 (1998); Ramm K et al., *J Mol Biol* 290: 535-46 (1999); Tanaka T, Rabbitts T, *J Mol Biol* 376: 749-57 (2008)).

In certain embodiments, the composition of the present invention comprises a multivalent CD20-binding molecule with one or more disulfide bonds between two or more cysteine residues contained within Shiga toxin effector regions of different polypeptide chains. In certain embodiments, the composition of the present invention comprises a proteinaceous, dimeric, multivalent CD20-binding molecule with five disulfide bonds, such as, e.g., the dimeric, multivalent CD20-binding molecule comprising: 1) four, intramolecular, disulfide bonds representing two disulfide bonds per immunoglobulin-derived CD20 binding region and where each disulfide bond involves a pair of cysteine residues and wherein one cysteine residue of each pair is within an immunoglobulin heavy chain derived domain and the other cysteine residue of the pair is within an immunoglobulin light chain derived domain; and 2) one, intermolecular, disulfide bond bridging two, Shiga toxin effector regions wherein the disulfide bond occurs between a pair of cysteine residues where each cysteine residue of the pair is within a Shiga toxin effector region but the Shiga toxin effector regions are within different polypeptide chains representing different subunits of a multivalent CD20-binding protein of the present invention.

In certain embodiments, the multivalent CD20-binding molecule of the present invention comprises a CD20 binding region derived from an immunoglobulin which has been engineered with certain camelid $V_HH$ "tetrad" mutations to improve solubility, to improve stability, and/or otherwise "camelize" the binding region (see e.g. Vincke C et al., *J Biol Chem* 284: 3273-84 (2009); Perchiacca J et al., *Proteins* 79: 2637-47 (2011); Gil D, Schrum A, *Adv Biosci Biotechnol* 4: 73-84 (2013)).

II. Examples of Specific Structural Variations of the Multivalent CD20-Binding Molecules of the Present Invention In certain embodiments, the multivalent CD20-binding molecule of the present invention comprises 1) two or more proteinaceous CD20 binding regions, each capable, on its own, of specifically binding an extracellular part of CD20; and 2) one or more Shiga toxin effector regions comprising a polypeptide derived from the amino acid sequence of the A Subunit of at least one member of the Shiga toxin family.

In certain embodiments, the multivalent CD20-binding molecule of the present invention comprises two or more CD20 binding regions comprising an immunoglobulin-type polypeptide selected for specific and high-affinity binding to the cellular surface of a CD20+ cell (see e.g. Table 9, infra).

In certain embodiments of the multivalent CD20-binding molecule of the present invention, the CD20 binding region comprises a polypeptide(s) selected from the group consisting of: a) a heavy chain variable ($V_H$) domain comprising i) a HCDR1 comprising or consisting essentially of the amino acid sequence as shown in SEQ ID NO:5, SEQ ID NO: 11, SEQ ID NO: 17, SEQ ID NO:23, SEQ ID NO:29, or SEQ ID NO:35; ii) a HCDR2 comprising or consisting essentially of the amino acid sequence as shown in SEQ ID NO:6, SEQ ID NO:12, SEQ ID NO:18, SEQ ID NO:24. SEQ ID NO:30, or SEQ ID NO:36; and iii) a HCDR3 comprising or consisting essentially of the amino acid sequence as shown in SEQ ID NO:7, SEQ ID NO: 13, SEQ ID NO: 19, SEQ ID NO:25, SEQ ID NO:31, or SEQ ID NO:37; and b) a light chain variable ($V_L$) domain comprising i) a LCDR1 comprising or consisting essentially of the amino acid sequence as shown in SEQ ID NO:8, SEQ ID NO: 14, SEQ ID NO:20, SEQ ID NO:26, SEQ ID NO:32, or SEQ ID NO:38; ii) a LCDR2 comprising or consisting essentially of the amino acid sequence as shown in SEQ ID NO:9, SEQ ID NO: 15, SEQ ID NO:21, SEQ ID NO:27, SEQ ID NO:33, or SEQ ID NO:39; and iii) a LCDR3 comprising or consisting essentially of the amino acid sequence as shown in SEQ ID NO: 10, SEQ ID NO: 16, SEQ ID NO:22, SEQ ID NO:28, SEQ ID NO:34, or SEQ ID NO:40. In certain further embodiments, the multivalent CD20-binding molecule of the present invention comprises the CD20 binding region comprising or consisting essentially of amino acids 1-232, 1-233, 1-234, 1-235, 1-236, 1-242, 1-243, 1-244, 1-245, 1-246, 1-252, 1-253, 1-254, 1-255, or 1-256 of any one of SEQ ID NOs: 47-119 and 176-248.

In certain embodiments, the multivalent CD20-binding molecule of the present invention comprises one or more Shiga toxin effector region(s), each comprising or consisting essentially of the polypeptide selected from the group consisting of: (a) amino acids 75 to 251 of SEQ ID NO: 1, SEQ ID NO:2, or SEQ ID NO:3; (b) amino acids 1 to 241 SEQ ID NO: 1, SEQ ID NO:2, or SEQ ID NO:3; (c) amino acids 1 to 251 of SEQ ID NO: 1. SEQ ID NO:2, or SEQ ID NO:3; and (d) amino acids 1 to 261 of SEQ ID NO: 1, SEQ ID NO:2, or SEQ ID NO:3.

In certain embodiments, the multivalent CD20-binding molecule of the present invention comprises one or more Shiga toxin effector regions comprising the substitution selected from at least one of the following: A231E, R75A, Y77S. Y114S, E167D, R170A, R176K, and W203A as positioned in the polypeptide shown in SEQ ID NO:1. SEQ ID NO:2, SEQ ID NO:3, and/or SEQ ID NO:4.

In certain embodiments, the multivalent CD20-binding molecule of the present invention comprises or consists essentially of two proteins, and comprises at least one disulfide bond. In certain further embodiments, the disulfide bond is between a pair of cysteine residues wherein a first cysteine residue of the pair is positioned at amino acid residue 242 or 261 of the polypeptide shown in SEQ ID NO: 1 or SEQ ID NO:2 or at amino acid residue position 241 or 260 in the polypeptide shown in SEQ ID NO:3 in a first Shiga toxin effector polypeptide region and a second cysteine residue of the pair is positioned at amino acid residue 242 or 261 of the polypeptide shown in SEQ ID NO: 1 or SEQ ID NO:2 or at amino acid residue position 241 or 260 in the polypeptide shown in SEQ ID NO:3 of second Shiga toxin effector polypeptide region (see e.g. FIG. 1A and FIG. 1B).

In certain embodiments, the multivalent CD20-binding molecule of the present invention comprises the protein shown in any one of SEQ ID NOs: 47-304, and optionally, the protein further comprises an amino-terminal methionine residue. In certain further embodiments, the multivalent CD20-binding molecule of the present invention comprises or consists essentially of two proteins, each protein selected from any one of the polypeptides shown in SEQ ID NOs: 47-304, and optionally, each protein further comprises an amino-terminal methionine residue. In certain further embodiments, each of the two proteins is selected from any one of the proteins shown in SEQ ID NOs: 47-175, and the multivalent CD20-binding molecule further comprises five disulfide bonds, each linking the sulfhydryl groups of a pair of cysteine residues; and wherein four of the five disulfide bonds involve cysteine residues which are in an immunoglobulin domain of a CD20-binding region of the protein linked to another cysteine residue in an immunoglobulin domain of the same CD20-binding region, and wherein the remaining disulfide bond of the five disulfide bonds involves a cysteine residue in a first protein of the two proteins shown in SEQ ID NOs: 47-175 at the position selected from the group consisting of: 242, 482, 483, 484, 490, 491, 492, 493, 494, 495, 499, 500, 501, 502, 503, 504, 505, 510, 511, 512, 513, and 521 linked to a cysteine residue from a second protein of the two proteins shown in SEQ ID NOs: 47-175 at the position selected from the group consisting of: 242, 482, 483, 484, 490, 491, 492, 493, 494, 495, 499, 500, 501, 502, 503, 504, 505, 510, 511, 512, 513, and 521.

It is within the scope of the present invention to use fragments, variants, and/or derivatives of the proteins of the multivalent CD20-binding molecules of the present invention, such as, e.g., proteins which contain two or more, functional, CD20 binding regions, and even more preferably two CD20 binding regions capable of binding an extracellular part of CD20 with high affinity (e.g. as determined using the CD20 binding region's $K_D$ empirically measured with a CD20-expressing cell(s) or in vitro with a CD20 target molecule(s)). For example, while the invention provides polypeptides that can bind to CD20, any binding region that binds to an extracellular part of CD20 with a dissociation constant of $10^{-5}$ to $10^{-12}$ moles per liter, preferably less than 200 nM, may be suitable for use in making multivalent CD20-binding molecules of the present invention, and related compositions and methods of the invention.

III. General Functions of the Multivalent CD20-Binding Molecule of the Present Invention and Compositions Thereof The present invention provides various multivalent CD20-binding molecules and compositions thereof wherein each multivalent CD20-binding molecule comprises 1) two or more CD20 binding regions for cell targeting; and 2) at least one Shiga toxin effector polypeptide region. The linking of multiple cell targeting, CD20 binding regions with Shiga toxin Subunit A derived regions enables the cell type-specific targeting of the potent Shiga toxin cytotoxicity and/or cytostasis, as well as the ability to deliver exogenous materials into the interiors of CD20+ cell types, such as, e.g., intracellularly cytotoxic agents.

In certain embodiments, the multivalent CD20-binding molecule of the present invention, and compositions thereof, may be used to target potent Shiga toxin cytotoxicity, cytostasis, rapid intracellular delivery of cargo, or other cellular internalization function to various, CD20-expressing cell types. In certain embodiments, the multivalent CD20-binding molecule of the present invention are capable of binding extracellular CD20 molecules associated with the cell surfaces of particular cell types and rapidly entering those cells. Once internalized within a targeted cell, certain embodiments of the multivalent CD20-binding molecules of the present invention are capable of routing a cytotoxic Shiga toxin effector polypeptide fragment into the cytosol of the target cell. Once in the cytosol of a targeted cell, certain embodiments of the cytotoxic multivalent CD20-binding molecules of the present invention are capable of enzymatically inactivating ribosomes, interfering with cell homeostasis, and eventually killing the cell. In certain embodiments, the multivalent CD20-binding molecule of the present invention, and compositions thereof, may be used to deliver additional exogenous materials into CD20-expressing cells, such as, e.g., peptides, polypeptides, proteins, polynucleotides, and detection promoting agents to label the interiors of target cells for collecting diagnostically useful information.

A. CD20+ Cell Kill Via Targeted Shiga Toxin Cytotoxicity

Because members of the Shiga toxin family are adapted to killing eukaryotic cells, multivalent CD20-binding molecules comprising a Shiga toxin effector region can show potent cell-kill activity. The A Subunits of members of the Shiga toxin family comprise enzymatic domains capable of killing a eukaryotic cell once in the cell's cytosol. Certain embodiments of the multivalent CD20-binding molecules of the present invention, and compositions thereof, take advantage of this cytotoxic mechanism. Certain embodiments of the multivalent CD20-binding molecules of the present invention, and compositions thereof, exhibit cell-targeted cytotoxicity via their Shiga toxin effector regions.

In certain embodiments of the multivalent CD20-binding molecules of the present invention, and compositions thereof, upon contacting a cell physically coupled with extracellular CD20 having the extracellular part bound by the binding regions of the multivalent CD20-binding molecule of the present invention, the multivalent CD20-binding molecule of the present invention, and/or a composition thereof, is capable of causing the death of the cell. In certain further embodiments, the capability to cause the death of the cell requires an intracellular mechanism, such as, e.g., a catalytic activity of a toxin effector region.

The killing of a CD20-expressing cell(s) may be accomplished using a cytotoxic multivalent CD20-binding molecule of the present invention, and/or a composition thereof, under varied conditions of CD20-expressing target cells, such as an ex vivo manipulated target cell, a target cell cultured in vitro, a target cell within a tissue sample cultured in vitro, and/or a target cell in vivo.

The expression of CD20 at a cellular surface need not be native to achieve targeted cell killing by a cytotoxic, multivalent CD20-binding molecule of the present invention and/or composition thereof. Cell-surface expression of CD20 by a target cell could be the result of an infection, the presence of a pathogen, and or the presence of an intracellular microbial pathogen. Expression of CD20 by a target cell could be artificial or engineered such as, for example, by forced or induced expression after infection with a viral expression vector, see e.g. adenoviral, adeno-associated viral, and retroviral systems. An example of inducing expression of CD20 is the up-regulation of CD20 induced by exposing a cell to ionizing radiation.

Whether a particular cell type or cell population expresses CD20 at a cellular surface can be determined by methods well known in the art. For example, both FACS methods and immunohistochemical methods using anti-CD20 antibodies are known in the art may be used to as assays to determine cells which express CD20 at a cellular surface (CD20+ cells) and, thus, determine which cells have a particular extracellular CD20 target biomolecule physically coupled to them. In addition, the density of CD20 expression at a cell surface of a CD20+ cell type may be assayed using methods known in the art, including but not limited to the methods mentioned herein.

The effectiveness and potency of multivalent CD20-binding molecules of the present invention toward different target cells may be influenced by the densities of their CD20 target antigen(s) on a target cell surface, the locations of their epitope-binding interaction with CD20, the rates of CD20 internalization of cell-surface bound CD20 of different target cells, and the intracellular itinerary of different target cells.

The cell surface representation and/or density of an extracellular CD20 target may influence the applications for which certain multivalent CD20-binding molecules of the present invention, or compositions thereof, may be most suitably used. Differences in cell surface representation and/or density of certain extracellular CD20 target(s) between cells may alter the internalization and/or cytotoxicity of a given multivalent CD20-binding molecule of the invention, or composition thereof, both quantitatively and qualitatively. The total cell surface representation of CD20 and/or of certain CD20 epitope(s) on a particular cell or population of cells may be determined using methods known to the skilled worker, such as by using fluorescence-activated cell sorting (FACS), flow-cytometry techniques.

An example of a FACS based assay for determining cell surface representation of an extracellular CD20 antigen for a particular cell type is as follows. An anti-CD20 antibody is labeled with a fluorophore, such as, e.g. a fluorescein derivative like fluorescein isothiocyanate (FITC), an Alexa Fluor® Dye like Alexa488, or some other fluorescent tag. A population of cells of the cell type of interest are grown and harvested at a density of $1\times10^6$ cells per milliliter (mL) and treated with 0.1 to 1.0 milligrams (mg) per mL (mg/mL) of labeled anti-CD20 antibody for 30 minutes on ice. Then the cold, treated cells are washed twice to remove unbound antibody. Alternatively, an unlabeled anti-CD20 antibody is used and is detected by a secondary antibody, such as, e.g., an anti-mouse IgG conjugated with a fluorophore, such as, e.g., Alexa488 or FITC. Direct immunofluorescence is used to quantify the amount of extracellular CD20 such as by using a FACS device.

For example, cell-surface CD20 is usually expressed at high levels by B-cells as compared to other cell surface targets, such as at levels of 250,000 cell-surface CD20 molecules per cell, which provides a large density of extracellular CD20 targets for the multivalent CD20-binding molecules of the present invention.

For certain embodiments of the multivalent CD20-binding molecule, and compositions thereof, the ability, upon contacting a cell physically coupled with extracellular CD20 having the extracellular part bound by the binding regions of the multivalent CD20-binding molecule, of killing the cell may or may not depend on the catalytic activity of one or more Shiga toxin effector regions of the multivalent CD20-binding molecule. In certain embodiments of the multivalent CD20-binding molecules of the present invention, and compositions thereof, upon contacting a cell physically coupled with extracellular CD20 having the extracellular part bound by the binding regions of the multivalent CD20-binding molecule, the multivalent CD20-binding molecule of the present invention, and/or a composition thereof, is capable of causing the death of the cell. In certain further embodiments, the multivalent CD20-binding molecule of the present invention either (1) comprises a Shiga toxin effector region(s) that lacks catalytic activity and/or is not capable of causing the death of a cell through a Shiga toxin effector-mediated, ribosome inactivation mechanism; or (2) does not comprise any Shiga toxin effector region.

Certain embodiments of the multivalent CD20-binding molecules of the present invention, and enriched compositions thereof, exhibit unexpectedly great, cell-targeted cytotoxicity potencies compared to monovalent CD20-binding molecules and/or compositions thereof which lack multivalent CD20-binding molecule(s) of the present invention or have lower proportions of multivalent CD20-binding molecule(s) of the present invention to the total CD20-binding molecule than an enriched composition of the present invention (i.e., a multivalent CD20-binding molecule composition of the present invention). Without being bound by theory, the CD20-binding valence-related improvement in function(s) between monovalent CD20-binding molecules and multivalent CD20-binding molecules of the present invention result from the multivalent CD20-binding structure in a way that is believed to be more than just a result of CD20-binding valency effect(s), but rather, seems to result from a de novo property(ies) of the multivalent CD20-binding structures of the present invention that is not present in monovalent CD20-binding variants. Without being bound by theory, multivalent CD20-binding molecules of the present invention, and enriched compositions thereof, that exhibit cytotoxic potencies that are unexpectedly greater in a qualitative and/or quantitative manner compared to a monovalent CD20-binding variant may exhibit such levels of cytotoxic potency as a result of an improvement(s), such as, e.g., in the molecule's efficiency of 1) cellular internalization into a CD20-expressing cell(s), 2) intracellular routing after cellular internalization to a certain subcellular compartment(s), and/or 3) delivering a Shiga toxin effector polypeptide to the cytosol.

In certain embodiments, the multivalent CD20-binding molecule of the present invention comprises one or more monovalent CD20-binding molecule components; and whereby upon administration of the multivalent CD20-binding molecule of the present invention, or a composition thereof, to a population of cells physically coupled with CD20 (e.g. CD20+ cells), which have the extracellular part bound by two or more CD20 binding regions of the multivalent CD20-binding molecule, the multivalent CD20-binding molecule exhibits a cytotoxic effect which is greater than a cytotoxic effect resulting from administration of an equivalent amount, mass, or molarity of any one of the monovalent CD20-binding molecule components of the multivalent CD20-binding molecule to a population of the same type of CD20 positive cells under same conditions (e.g., same temperature, cell density, and assay time duration) by a factor of 1.33, 1.5, 1.75, 2, 3, 5, 7.5, 10, 20, 100, or greater than (1) the change in CD20-binding valence between the monovalent CD20-binding component and the multivalent CD20-binding molecule; (2) the change in equilibrium binding constants ($K_D$) between the multivalent CD20-binding molecule and the monovalent CD20-binding component for binding to CD20 or CD20-expressing cell; and/or (3) the change in affinity constant ($1/K_D$) between the multivalent CD20-binding molecule and the monovalent CD20-binding component for binding to CD20 or CD20-expressing cell. For certain further embodiments, members of the population of cells express at a cellular surface the CD20 which (1) have the extracellular part bound by the two or more CD20 binding regions of the multivalent CD20-binding molecule wherein each CD20 binding region is tested in isolation from the multivalent CD20-binding molecule, (2) have a transmembrane domain, and (3) remain physically coupled to the cell. For certain further embodiments, members of the population of cells are CD20 positive cells. For certain embodiments, the members of the population of cells are physically coupled with a significant amount of extracellular CD20 which (1) have the extracellular part bound by the two or more CD20 binding regions of the multivalent CD20-binding molecule. For certain further embodiments, members of the population of cells are descendants or members of a B-cell lineage. For certain further embodiments, members of the population of cells are selected from the group consisting of: malignant B-cell. B-cell leukemia cell, B-cell lymphoma cell, B-cell myeloma cell, acute myeloid leukemia cell, acute non-lymphocytic leukemia cell. B-cell chronic lymphocytic leukemia cell, B-cell lymphoma cell, B-cell non-Hodgkin's lymphoma cell, B-cell precursor acute lymphoblastic leukemia cell. B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell. Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

B. Selective Cytotoxicity Among a Mixture of Different Cells

The cytotoxic, multivalent CD20-binding molecules of the present invention, and compositions thereof, are useful for the elimination of populations of specific cell types within the presence of untargeted cells or "bystander" cells. For example, the cytotoxic, multivalent CD20-binding molecules of the invention, and compositions thereof, are useful for the treatment of certain tumors, cancers, and/or growth abnormalities by eliminating CD20-expressing cells that express elevated levels of CD20 at one or more cellular surfaces. By targeting the delivery of enzymatically active Shiga toxin regions using multiple, high-affinity CD20 binding regions to CD20 expressing cells, Shiga toxin cell-kill activity can be restricted to preferentially killing CD20-expressing cell types that express CD20 at a cellular surface (e.g. CD20+ cells), such as, e.g., certain neoplastic or malignant plasma cells, in the presence of two or more cell types where at least one cell type population expresses more CD20 than at least one other cell type population.

In certain embodiments, the cytotoxic CD20-binding molecule of the present invention is capable of selectively or preferentially causing the death of a specific cell type within a mixture of two or more different cell types. This enables the targeted cytotoxic activity to specific cell types with a high preferentiality, such as a 3-fold cytotoxic effect, over "bystander" cell types that do not express extracellular CD20.

In certain embodiments, administration of the multivalent CD20-binding molecule of the present invention to a mixture of cell types, the multivalent CD20-binding molecule is capable of selectively killing CD20-expressing cells displaying an extracellular CD20 target compared to cell types lacking extracellular CD20 target(s) of the binding region(s) of the multivalent CD20-binding molecule.

In certain embodiments, upon administration of the cytotoxic multivalent CD20-binding molecule of the present invention to a mixture of cell types, the cytotoxic multivalent CD20-binding molecule is capable of selectively killing CD20+ cells expressing an extracellular CD20 target biomolecule compared to cells lacking any cell-surface expression of extracellular CD20 target biomolecules.

Certain CD20 positive, cell types may be killed by a multivalent CD20-binding molecule of the present invention, or compositions thereof, in the presence of other cells, including other CD20 positive cells, based on different levels of extracellular CD20 target expression among the target cells and non-target cells. For example, cells which overexpress CD20 may be killed among healthy cells, whether the healthy cells are expressing CD20 or not.

A cell which "overexpresses" a target biomolecule includes a cell which has significantly higher levels of the target biomolecule physically coupled at its cell surface compared to a healthy cell of the same tissue type. Overexpression may be caused by a variety of circumstances, such as, e.g., gene amplification, increased transcription, increased translation, reduced CD20 shedding, and/or reduced removal of the CD20 target biomolecule. The skilled worker may determine overexpression of a particular target biomolecule using methods known in the art.

Levels of extracellular CD20 target biomolecules on the surface of cells may be determined using various methods known to the skilled worker, such as, e.g., FACS methods. As used herein, a significant amount of an extracellular CD20 expressed at a cellular surface is greater than 10,000, 20,000, 30,000, 40,000, or 50,000 mean fluorescence intensity (MFI) by FACS analysis depending on the cell type.

The cytotoxic multivalent CD20-binding molecules of the present invention are useful for reducing or eliminating populations of a specific cell type(s). For example, the cytotoxic multivalent CD20-binding molecules of the present invention are useful for the treatment of certain tumors, cancers, and/or growth abnormalities by eliminating CD20+ cells that express elevated levels of CD20 at one or more cellular surfaces (e.g. cells characterized as overexpressing CD20).

In certain embodiments, the multivalent CD20-binding molecule of the present invention may be used to target cytotoxic activity to specific cell types with a high preferentiality, such as with at least a 3-fold cytotoxic effect, over "bystander" cell types that are CD20+ but express cell-surface CD20 at lower cell surface amounts or densities than target cells. The expression of CD20 may be non-exclusive to one cell type if extracellular CD20 is expressed in low enough amounts by cell types that are not to be targeted. Thus, preferential killing of one CD20 positive cell type may be accomplished in mixtures of multiple CD20+ where some CD20+ cell types are bystander cells, such as mixtures of CD20+ cell types with varying CD20 expression levels, optionally in the presence of CD20 negative cells as well. This enables the preferential cell-killing of high-expressing CD20 cell types, such as a 3-fold cytotoxic effect, over "bystander" cell types that do not express significant amounts of CD20 or do not expose significant amounts of an extracellular CD20 target of at least one of the CD20 binding regions of the cytotoxic multivalent CD20-binding molecules.

In certain embodiments, the cytotoxic activity of a multivalent CD20-binding molecule of the present invention toward populations of cell types physically coupled with an extracellular CD20 target is at least 3-fold higher than the cytotoxic activity toward populations of cell types not physically coupled with significant amounts of an extracellular CD20 target bound specifically by at least one of the CD20 binding regions of that multivalent CD20-binding molecule. According to the present invention, selective cytotoxicity may be quantified in terms of the ratio (a/b) of (a) cytotoxicity towards a population of cells physically coupled with a significant amount of an extracellular CD20 target of at least one of the CD20 binding regions of the multivalent CD20-binding molecule of the invention to (b) cytotoxicity towards a population of cells of a cell type not physically coupled with a significant amount of an extracellular CD20 target of at least one of the CD20 binding regions of the multivalent CD20-binding molecule of the invention.

In certain embodiments, the cytotoxicity ratio is indicative of the selective cytotoxicity which is at least 3-fold, 5-fold, 10-fold, 15-fold, 20-fold, 25-fold, 30-fold, 40-fold, 50-fold, 75-fold, 100-fold, 250-fold, 500-fold, 750-fold, 1000-fold or higher for populations of cells or cell types expressing or physically coupled with an extracellular CD20 target of at least one of the CD20 binding regions of the multivalent CD20-binding molecule of the present invention compared to populations of cells or cell types which do not express an extracellular CD20 target or that are not physically coupled with significant amounts of an extracellular CD20 target bound specifically by at least one of the CD20 binding regions of the multivalent CD20-binding molecule of the present invention. For example, upon administration of certain multivalent CD20-binding molecule of the present invention to two different populations of cells which differ with respect to the presence and/or polypeptide sequence of extracellular CD20 target biomolecule, the multivalent CD20-binding molecule is capable of causing cell death to the cell type(s) physically coupled with an extracellular CD20 target biomolecule bound by at least one of the multivalent CD20-binding molecule's CD20 binding regions, e.g., at a $CD_{50}$ at least three times less than the $CD_{50}$ of binding to cell types that are not physically coupled with an extracellular CD20 target of the multivalent CD20-binding molecule's CD20 binding region.

In certain embodiments of the multivalent CD20-binding molecules of the present invention, upon administration of the multivalent CD20-binding molecule to two different populations of cell types, the multivalent CD20-binding molecule is capable of causing cell death as defined by the half-maximal cytotoxic concentration ($CD_{50}$) to a first cell population, whose members express CD20 at a cellular surface, at a dose at least three-times lower than the $CD_{50}$ dose of the same multivalent CD20-binding molecule to a second population of cells whose members do not express CD20, do not express a significant amount of CD20, or are not exposing a significant amount of an extracellular CD20 target of at least one of the CD20 binding regions of the multivalent CD20-binding molecule.

According to the present invention, selective cytotoxicity may be quantified in terms of the ratio (a/b) of (a) cytotoxicity towards a population of CD20+ cells to (b) cytotoxicity towards a population of CD20 negative cells. In certain embodiments, the cytotoxicity ratio is indicative of selective cytotoxicity which is at least 3-fold, 5-fold, 10-fold, 15-fold, 20-fold, 25-fold, 30-fold, 40-fold, 50-fold, 75-fold, 100-fold, 250-fold, 500-fold, 750-fold, or 1000-fold higher for populations of CD20+ cells or CD20+ cell populations compared to CD20− cells or CD20− cell populations. For example, administration of certain embodiments of the multivalent CD20-binding molecule to two different populations of cell types with respect to the presence of an extracellular CD20 target biomolecule, the multivalent CD20-binding molecule is capable of causing cell death to the CD20 target biomolecule positive cells at a $CD_{50}$ at least three times less than the $CD_{50}$ to CD20 target biomolecule negative cells.

Particular CD20 expression levels within an organism may be limited to unique cells, tissues, cell types, conditions, disease states, disorders, and/or cellular contexts. CD20 may be overexpressed by cells involved in many disease states, such as, e.g., by malignant immune cells, tumor cells, and cancer cells.

In certain embodiments, administration of the multivalent CD20-binding molecule composition of the present invention to a mixture of cell types, the multivalent CD20-binding molecule composition is capable of selectively killing CD20-expressing cells displaying an extracellular CD20 target compared to cell types lacking an extracellular CD20 target(s) of the multivalent CD20-binding molecule of the composition of the invention.

In certain further embodiments, administration of the multivalent CD20-binding molecule composition of the present invention to two populations of cell types which differ in the presence and/or polypeptide sequence of a extracellular CD20 target, the multivalent CD20-binding molecule composition is capable of causing cell death as defined by the half-maximal cytotoxic concentration ($CD_{50}$) to a population of CD20+ target cells, e.g., at a dose at least three times lower than the $CD_{50}$ dose of the same multivalent CD20-binding molecule composition to a CD20-cell population.

According to the present invention, selective cytotoxicity may be quantified in terms of the ratio (a/b) of (a) cytotoxicity towards a population of CD20+ cells to (b) cytotoxicity towards a population of CD20– cells. In certain embodiments, the cytotoxicity ratio is indicative of selective cytotoxicity which is at least 3-fold, 5-fold, 10-fold, 15-fold, 20-fold, 25-fold, 30-fold, 40-fold, 50-fold, 75-fold, 100-fold, 250-fold, 500-fold, 750-fold, or 1000-fold higher for populations of CD20+ cells or CD20+ cell populations compared to CD20– cells or CD20– cell populations. For example, administration of certain embodiments of the multivalent CD20-binding molecule composition of the present invention to two different populations of cell types with respect to the presence of an extracellular CD20 target biomolecule, the multivalent CD20-binding molecule compositions are capable of causing cell death to the CD20 target biomolecule positive cells at a $CD_{50}$ at least three times less than the $CD_{50}$ to CD20 target biomolecule negative cells.

In certain embodiments, the multivalent CD20-binding molecule compositions of the present invention are capable of selectively or preferentially causing the death of a specific cell type within a mixture of two or more different cell types. This enables targeting cytotoxic activity to specific cell types with a high preferentiality, such as with at least a 3-fold cytotoxic effect, over "bystander" cell types that do not express any significant amount of the appropriate extracellular CD20 target(s), such as, e.g., CD20 negative cells. This enables the targeted cell-killing of specific cell types expressing CD20 on cellular surfaces with a high preferentiality, such as with at least a 3-fold cytotoxic effect, over "bystander" cell types that do not express significant amounts of the appropriate CD20 target(s) or are not exposing significant amounts of the appropriate CD20 target at a cellular surface.

Levels of extracellular CD20 expressed on the surface of a cell or cell population may be determined using various methods known to the skilled worker, such as, e.g., FACS methods. As used herein, a significant amount of an extracellular CD20 expressed at a cellular surface is greater than 10,000, 20,000, 30,000, 40,000, or 50,000 mean fluorescence intensity (MFI) by FACS analysis depending on the cell type.

Alternatively, certain multivalent CD20-binding molecules of the present invention, and compositions thereof, enable targeting cytotoxic activity to specific cell types with a high preferentiality, such as with at least a 3-fold cytotoxic effect, over "bystander" cell types that are CD20+ but express CD20 at lower cell surface amounts or densities than target cells. Thus, preferential killing of one CD20 positive cell type may be accomplished in mixtures of multiple CD20+ cell types where some CD20+ cell types are bystander cells, such as mixtures of CD20+ cell types with varying CD20 expression levels, and optionally in the presence of CD20 negative cells as well.

In certain embodiments, the cytotoxic activity toward populations of cell types physically coupled with an extracellular CD20 target is at least 3-fold higher than the cytotoxic activity toward populations of cell types not physically coupled with significant amounts of extracellular CD20 target(s) of at least one of the CD20 binding regions of the cytotoxic, multivalent CD20-binding molecule of the present invention. According to the present invention, selective cytotoxicity may be quantified in terms of the ratio (a/b) of (a) cytotoxicity towards a population of cells physically coupled with a significant amount of an extracellular CD20 target of at least one of the CD20 binding regions of the cytotoxic, multivalent CD20-binding molecule to (b) cytotoxicity towards a population of cells of a cell type not physically coupled with a significant amount of an extracellular CD20 target of at least one of the CD20 binding regions of the cytotoxic, multivalent CD20-binding molecule. In certain embodiments, the cytotoxicity ratio is indicative of selective cytotoxicity which is at least 3-fold, 5-fold, 10-fold, 15-fold, 20-fold, 25-fold, 30-fold, 40-fold, 50-fold, 75-fold, 100-fold, 250-fold, 500-fold, 750-fold, or 1000-fold higher for populations of cells or cell types expressing an extracellular CD20 target or physically coupled with an extracellular CD20 target of at least one of the CD20 binding regions of the cytotoxic, multivalent CD20-binding molecule compared to populations of cells or cell types which do not express an extracellular CD20 target or are not physically coupled with significant amounts of an extracellular CD20 target of at least one of the CD20 binding regions of the cytotoxic, multivalent CD20-binding molecule. For example, administration of certain embodiments of the multivalent CD20-binding molecule composition of the present invention to two different populations of cell types with respect to the presence of an extracellular CD20 target biomolecule, the multivalent CD20-binding molecule composition is capable of causing cell death to the cell type(s) physically coupled with an extracellular CD20 target biomolecule of one or more of its CD20 binding regions at a $CD_{50}$ at least three times less than the $CD_{50}$ to cell types which are not physically coupled with an extracellular CD20 target of its CD20 binding region.

In certain embodiments of the multivalent CD20-binding molecule composition of the present invention, administration of the multivalent CD20-binding molecule composition to two different populations of cell types, the multivalent CD20-binding molecule composition is capable of causing cell death as defined by the half-maximal cytotoxic concentration ($CD_{50}$) to a first cell population, whose members express CD20 at a cellular surface, at a dose at least three-times lower than the $CD_{50}$ dose of the same multivalent CD20-binding molecule compositions to a second population of cells whose members do not express CD20, do not express a significant amount of CD20, or are not exposing a significant amount of an extracellular CD20 target of at least one of the CD20 binding regions of the multivalent CD20-binding molecule composition.

In certain embodiments, the cytotoxic activity of a multivalent CD20-binding molecule composition of the present invention toward populations of cell types expressing CD20 at a cellular surface is at least 3-fold higher than the cytotoxic activity toward populations of cell types not physically coupled with any extracellular CD20 target bound specifically by a multivalent CD20-binding molecule of the multivalent CD20-binding molecule composition.

According to the present invention, selective cytotoxicity may be quantified in terms of the ratio (a/b) of (a) cytotoxicity towards a population of cells expressing an extracellular CD20 target of a CD20 binding region of the embodiment to (b) cytotoxicity towards a population of cells of a cell type not physically coupled with any extracellular CD20 target of a CD20 binding region of the embodiment. In certain embodiments, the cytotoxicity ratio is indicative of selective cytotoxicity which is at least 3-fold, 5-fold, 10-fold, 15-fold, 20-fold, 25-fold, 30-fold, 40-fold, 50-fold, 75-fold, 100-fold, 250-fold, 500-fold, 750-fold, or 1000-fold higher for populations of cells or cell types expressing CD20 compared to populations of cells or cell types which do not express CD20.

In certain embodiments, the cytotoxic activity of a multivalent CD20-binding molecule composition of the present invention toward populations of cell types physically coupled with an extracellular CD20 target is at least 3-fold higher than the cytotoxic activity toward populations of cell types not physically coupled with significant amounts of an extracellular CD20 target bound specifically by at least one of the CD20 binding regions of a multivalent CD20-binding molecule of the multivalent CD20-binding molecule composition. According to the present invention, selective cytotoxicity may be quantified in terms of the ratio (a/b) of (a) cytotoxicity towards a population of cells physically coupled with a significant amount of an extracellular CD20 target of at least one of the CD20 binding regions of a cytotoxic multivalent CD20-binding molecule of the present invention to (b) cytotoxicity towards a population of cells of a cell type not physically coupled with a significant amount of an extracellular CD20 target of at least one of the CD20 binding regions of the cytotoxic multivalent CD20-binding molecule. In certain embodiments, the cytotoxicity ratio is indicative of selective cytotoxicity which is at least 3-fold, 5-fold, 10-fold, 15-fold, 20-fold, 25-fold, 30-fold, 40-fold, 50-fold, 75-fold, 100-fold, 250-fold, 500-fold, 750-fold, 1000-fold or higher for populations of cells or cell types expressing an extracellular CD20 target or physically coupled with an extracellular CD20 target of at least one of the CD20 binding regions of a cytotoxic multivalent CD20-binding molecule of the composition of the invention compared to populations of cells or cell types which do not express an extracellular CD20 target or that are not physically coupled with significant amounts of an extracellular CD20 target bound specifically by any of the CD20 binding regions of the cytotoxic multivalent CD20-binding molecule of the composition of the invention. For example, upon administration of certain multivalent CD20-binding molecule compositions of the invention to two different populations of cells which differ with respect to the presence and/or polypeptide sequence of extracellular CD20 target biomolecule, the multivalent CD20-binding molecule compositions are capable of causing cell death to the cell type(s) physically coupled with an extracellular CD20 target biomolecule bound by at least one of the CD20 binding regions of a multivalent CD20-binding molecule of the composition, e.g., at a $CD_{50}$ at least three times less than the $CD_{50}$ of binding to cell types that are not physically coupled with an extracellular CD20 target of any of the multivalent CD20-binding molecules of the composition.

In certain embodiments of the multivalent CD20-binding molecule composition of the present invention, upon administration of the multivalent CD20-binding molecule composition to two different populations of cell types, the multivalent CD20-binding molecule composition is capable of causing cell death as defined by the half-maximal cytotoxic concentration ($CD_{50}$) to a first cell population, whose members express CD20 at a cellular surface, at a dose at least three-times lower than the $CD_{50}$ dose of the same multivalent CD20-binding molecule composition to a second population of cells whose members do not express CD20, do not express a significant amount of CD20, or are not exposing a significant amount of an extracellular CD20 target of at least one of the CD20 binding regions of any cytotoxic, multivalent CD20-binding molecule of the multivalent CD20-binding molecule composition.

This preferential cell-killing function allows a targeted CD20+ cell to be killed by certain multivalent CD20-binding molecules of the present invention, and compositions thereof, under varied conditions and in the presence of non-targeted CD20− bystander cells, such as ex vivo manipulated mixtures of cell types, in vitro cultured tissues with mixtures of cell types, or in vivo in the presence of multiple cell types (e.g. in situ, in a native location within a multicellular organism, or at disease locus within a multicellular organism).

In certain embodiments, upon administration of the multivalent CD20-binding molecule of the present invention, and/or composition thereof, to a mixture of cell types, the multivalent CD20-binding molecule, and/or composition thereof, is capable of selectively killing CD20+ cells expressing an extracellular CD20 target biomolecule compared to cells lacking any cell-surface expression of extracellular CD20 target biomolecules. By targeting the delivery of enzymatically active Shiga toxin regions to specific cell types using high-affinity CD20 binding regions, this potent and selective cell-kill activity can be restricted to killing only CD20 expressing cells within in an organism.

In certain embodiments of the invention, the multivalent CD20-binding molecules of the present invention, and compositions thereof, have applications in killing CD20+ cells in a disease, disorder or condition involving cells with abnormally high CD20 expression and/or ectopic CD20 expression. Various types of cells which express CD20 may be targeted by the multivalent CD20-binding molecules of the present invention, and compositions thereof, for cell killing and/or cytostasis. For example, there are various types of CD20+ cells which function in various biological processes including autoimmune conditions, neoplastic B-cell proliferation, and hypersensitivity responses.

C. Delivery of an Additional, Exogenous Material into the Interior of a Target Cell In addition to direct cell killing, multivalent CD20-binding molecules of the present invention, and compositions thereof, optionally may be used for delivery of additional exogenous materials into the interiors of target cells. The delivery of additional exogenous materials may be used, e.g., for cytotoxic, cytostatic, information gathering, and/or diagnostic functions. Non-toxic variants of the cytotoxic, multivalent CD20-binding molecules of the present invention, or optionally toxic variants, may be used to deliver additional exogenous materials to and/or label the interiors of cells physically coupled with an extracellular CD20 molecule. Various types of cells and/or cell populations which express CD20 at one or more cellular surfaces may be targeted by the multivalent, CD20-binding molecules of the present invention for receiving exogenous materials. The functional components of the present invention are modular in that various Shiga toxin effector regions and additional exogenous materials may be linked to various CD20 binding regions to create varied, multivalent CD20-binding molecules of the present invention that are suitable for use in diverse applications, such as non-invasive, in vivo imaging of tumor cells.

Because the multivalent CD20-binding molecules, whether cytotoxic or nontoxic, and catalytically inactive forms thereof, are capable of entering cells physically coupled with CD20 molecule, certain embodiments of the multivalent, CD20-binding molecules of the present invention may be used to deliver additional exogenous materials into the interior of targeted CD20+ cell types. In one sense, the entire multivalent CD20-binding molecule is an exogenous material which will enter the target cell; thus, the "additional" exogenous materials are heterologous materials linked to but other than the core, multivalent CD20-binding molecule itself, which is composed of merely of the minimum required components to achieve rapid cellular internalization and/or efficient sub-cellular routing to the desired intracellular compartment(s).

"Additional exogenous material" as used herein refers to one or more molecules, often not generally present within a native CD20+ target cell, where the multivalent CD20-binding molecules of the present invention can be used to specifically transport such material into the interior of a cell.

Non-limiting examples of additional exogenous materials are cytotoxic agents, peptides, polypeptides, proteins, polynucleotides, small molecule chemotherapeutic agents, radionuclides, and detection promoting agents.

Nontoxic variants of the cytotoxic CD20-binding molecules of the present invention, and compositions thereof, or optionally toxic variants, may be used to deliver additional exogenous materials and/or label the interiors of cells physically coupled with CD20 molecules bound by the multivalent CD20-binding molecules of the present invention. Various types of cells and/or cell populations which express CD20 at a cellular surface may be targeted by the multivalent CD20-binding molecules of the present invention, and compositions thereof, for killing and/or receiving exogenous materials, such as detection promoting agents. The system of the present invention is modular, in that various Shiga toxin effector regions and additional exogenous materials may be linked to the same binding region to provide diverse applications, such as, e.g., non-invasive in vivo imaging of the interiors of tumor cells and/or immune cells.

In certain embodiments of the multivalent CD20-binding molecules of the present invention, and compositions thereof, for use in delivery of additional exogenous materials into the interior of a cell, the additional exogenous material is a cytotoxic agent, such as, e.g., a small molecule chemotherapeutic agent, cytotoxic antibiotic, alkylating agent, antimetabolite, topoisomerase inhibitor, and/or tubulin inhibitor. Non-limiting examples of cytotoxic agents include aziridines, cisplatins, tetrazines, procarbazine, hexamethylmelamine, *vinca* alkaloids, taxanes, camptothecins, etoposide, doxorubicin, mitoxantrone, teniposide, novobiocin, aclarubicin, anthracyclines, actinomycin, bleomycin, plicamycin, mitomycin, daunorubicin, epirubicin, idarubicin, dolastatins, maytansines, docetaxel, adriamycin, calicheamicin, auristatins, pyrrolobenzodiazepine, carboplatin, 5-fluorouracil (5-FU), capecitabine, mitomvcin C, paclitaxel, 1,3-Bis(2-chloroethyl)-1-nitrosourea (BCNU), rifampicin, cisplatin, methotrexate, and gemcitabine.

In certain embodiments, the additional exogenous material comprises a protein or polypeptide comprising an enzyme. In certain other embodiments, the additional exogenous material is a nucleic acid, such as, e.g. a ribonucleic acid that functions as a small inhibiting RNA (siRNA) or microRNA (miRNA). In certain embodiments, the additional exogenous material is an antigen, such as antigens derived from bacterial proteins, viral proteins, proteins mutated in cancer, proteins aberrantly expressed in cancer, or T-cell complementary determining regions. For example, exogenous materials include antigens, such as those characteristic of antigen-presenting cells infected by bacteria, and T-cell complementary determining regions capable of functioning as exogenous antigens. In certain embodiments, the additional exogenous material comprises a proapoptotic peptide, polypeptide, or protein, such as, e.g., BCL-2, caspases, cytochromes, granzyme B, apoptosis-inducing factor (AIF), BAX, tBid (truncated Bid), and proapoptotic fragments or derivatives thereof (see e.g. Ellerby H et al., *Nat Med* 5: 1032-8 (1999); Mai J et al., *Cancer Res* 61: 7709-12 (2001); Liu Y et al., *Mol Cancer Ther* 2: 1341-50 (2003); Perea S et al., *Cancer Res* 64: 7127-9 (2004); Dllken B et al., *Cell Death Differ* 13: 576-85 (2006); Kwon M et al., *Mol Cancer Ther* 7: 1514-22 (2008); Wang F et al., *Clin Cancer Res* 16: 2284-94 (2010); Kim J et al., *J Virol* 85: 1507-16 (2011)). Additional examples of exogenous materials include proteins larger than an antigenic peptide, such as enzymes. Exogenous materials comprising a protein may optionally comprise one or more antigens whether known or unknown to the skilled worker.

In certain embodiments of the multivalent CD20-binding molecules of the present invention, and compositions thereof, for use in delivery of additional exogenous materials into the interior of a cell, the additional exogenous material is one or more radionucleides, such as, e.g., $^{211}$At, $^{131}$I, $^{125}$I, $^{111}$In, $^{186}$Re, $^{188}$Re, $^{153}$Sm, $^{212}$Bi, $^{32}$P, $^{60}$C, and/or radioactive isotopes of Lu.

In certain embodiments, the multivalent CD20-binding molecule of the present invention comprises an additional exogenous material for delivery into a cell, and the multivalent CD20-binding molecule comprises the protein shown in any one of SEQ ID NOs: 51-52, 59-61, 64-65, 71-73, 76-77, 82-83, 88-89, 94, 100, 106, 109-112, 115-118, 124, 132, 140, 145, 150, 156, 162, 168, 171, 174, 180-181, 189-190, 193-194, 200-202, 205-206, 211-212, 217-218, 223, 229, 235, 238-241, 244-247, 253, 261, 269, 274, 279, and 285; and optionally, the protein further comprises an amino-terminal methionine residue. In certain further embodiments, the multivalent CD20-binding molecule of the present invention comprises or consists essentially of two proteins, each protein selected from any one of the polypeptides shown in SEQ ID NOs: 51-52, 59-61, 64-65, 71-73, 76-77, 82-83, 88-89, 94, 100, 106, 109-112, 115-118, 124, 132, 140, 145, 150, 156, 162, 168, 171, 174, 180-181, 189-190, 193-194, 200-202, 205-206, 211-212, 217-218, 223, 229, 235, 238-241, 244-247, 253, 261, 269, 274, 279, and 285; and optionally, each protein further comprises an amino-terminal methionine residue. In certain further embodiments, the protein is selected from any one of the proteins shown in SEQ ID NOs: 51-52, 59-61, 64-65, 71-73, 76-77, 82-83, 88-89, 94, 100, 106, 109-112, 115-118, 124, 132, 140, 145, 150, 156, 162, 168, 171, and 174, and further comprises a disulfide bond involving a cysteine residue at the position selected from the group consisting of: 242, 482, 483, 484, 490, 491, 492, 493, 494, 495, 499, 500, 501, 502, 503, 504, 505, 510, 511, 512, 513, and 521.

For certain embodiments, upon administration of the multivalent CD20-binding molecule, and/or a composition thereof, to one or more cells physically coupled with CD20, which have the extracellular part bound by the two or more CD20 binding regions of the multivalent CD20-binding molecule, the multivalent CD20-binding molecule internalizes into one or more of the cells and delivers an additional exogenous material into the interior of the cell(s) or at least some of the cells.

For certain embodiments of the multivalent CD20-binding molecule of the present invention and compositions thereof, a cellular internalization rate may be measured as the time after administration (on average) at which the multivalent CD20-binding molecule of the present invention is observed inside a cell(s) and/or a majority of the cells contacted with the multivalent CD20-binding molecule and/ or composition thereof. For example, the anti-CD20 monoclonal antibody rituximab typically reaches maximal cellular internalization at 37° C. after approximately 16 to 18 hours, and thus, in the context of the present invention, a "rapid internalization" would indicate internalization rate several hours faster than that observed for rituximab, on average at the same temperature and receptor occupancy level.

For certain embodiments, upon administration of the multivalent CD20-binding molecule, and/or a composition thereof, to one or more cells physically coupled with CD20, which have the extracellular part bound by the two or more CD20 binding regions of the multivalent CD20-binding molecule, the multivalent CD20-binding molecule internalizes into one or more of the cells and delivers an additional exogenous material into the interior of the cell in about five hours, four hours, three hours, two hours, one hour, thirty minutes, or less at a physiological temperature appropriate for the cell and/or at about 37 degrees Celsius. For certain further embodiments, the cell(s) expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, the cell(s) is a CD20 positive cell. For certain embodiments, the cell(s) is physically coupled with a significant amount of extracellular CD20 which (1) have the extracellular part bound by the two or more CD20 binding regions of the multivalent CD20-binding molecule. For certain embodiments, the cell(s) is a descendant or member of a B-cell lineage. For certain embodiments, the cell(s) is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For purposes of certain embodiments of the present invention, the phrase "in less than about thirty minutes" means that the maximal (or half-maximal in certain contexts) observed amount of intracellular CD20, CD20 antigen, and/or multivalent CD20-binding molecule during a internalization assay time course is observed at or before thirty minutes from the step of contacting CD20 positive cell(s) with the multivalent CD20-binding molecule of the present invention as determined by an appropriate assay at conditions similar to 37° C. and 50 nM of multivalent CD20-binding molecule. The time of maximal or half-maximal intracellular accumulation may be determined by comparing intracellular accumulation at different times to find a peak or plateau. If a plateau is observed, then the maximal intracellular accumulation may be determined to be the first time the plateau reaches its highest point.

The extracellular CD20 cell surface density and the $K_D$ of a CD20-binding molecule may be used to calculate the percent occupancy for a given concentration of CD20-binding molecule, such as a CD20-binding molecule of the present invention or a reference CD20-binding molecule (e.g. monoclonal antibody) known to the skilled worker. For example, the CD20 receptor occupancy may be determined as a function of the 1) binding interaction between the extracellular CD20 receptor and CD20-binding molecule, 2) amount (e.g., concertation or effective concentration) of extracellular CD20 receptor available for binding, and 3) the amount (e.g., mass, concertation, or molarity) of CD20-binding molecule present in a given situation.

In certain embodiments, internalization rates of a multivalent CD20-binding molecule of the present invention compared to a CD20 antibody known in the art may be determined using assays performed at comparable extracellular CD20 receptor occupancies, instead of being determined using assays performed at comparable concentrations of the administered CD20-binding molecules (i.e. a multivalent CD20-binding molecule of the present invention and a reference, anti-CD20 antibody of prior art). The percent CD20 receptor occupancy ($RO_{CD20}$) may be determined using models and formulae, such as, e.g., $$RO_{CD20} = \frac{K_D + A_{tot} + CD20_{tot} - \sqrt{(-K_D - A_{tot} - CD20_{tot})^2 - 4 \cdot A_{tot} \cdot CD20_{tot}}}{2 \cdot CD20_{tot}}$$

where RO is the receptor occupancy of the extracellular CD20 in the internalization assay, $K_D$ is the dissociation constant of the CD20 binding molecule of interest to the extracellular CD20 receptor, $A_{tot}$ is the total number of CD20 binding molecules in the assay, and $CD20_{tot}$ is the total number of cell surface CD20 molecules in the assay (see e.g. Muller P, Brennan F, *Clin Pharmacol Ther* 85: 247-58 (2009); U.S. Ser. No. 14/965,882).

For certain embodiments of the multivalent CD20-binding molecule of the present invention, which comprises an additional exogenous material; whereby upon administration of the multivalent CD20-binding molecule, or a composition thereof, to a plurality of cells physically coupled with CD20, which have the extracellular part bound by the two or more CD20 binding regions of the multivalent CD20-binding molecule, at a concentration of multivalent CD20-binding molecule equivalent to five or thirty-eight percent to fifty percent cell-surface occupancy, the majority of the multivalent CD20-binding molecule internalizes into the plurality of cells and delivers the additional exogenous material into the interiors of the majority of the plurality of cells in about five hours, four hours, three hours, two hours, one hour, thirty minutes, or less at a physiological temperature appropriate for the cell and/or at about 37 degrees Celsius. For certain further embodiments, members of the plurality of cells express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, members of the plurality of cells are CD20 positive cells. For certain embodiments, the members of the plurality of cells are physically coupled with a significant amount of extracellular CD20 which (1) have the extracellular part bound by the two or more CD20 binding regions of the multivalent CD20-binding molecule. For certain embodiments, members of the plurality of cells are descendants or members of a B-cell lineage. For certain embodiments, members of the plurality of cells are selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

Because certain multivalent CD20-binding molecules of the present invention, and compositions thereof, exhibit specific cell-targeting and efficient cellular internalization (e.g. within thirty minutes after administration), a cytotoxic cargo (such as, e.g., a cytotoxic agent, ribonucleic acid, antigen, and/or proapoptotic peptide) conjugated to a multivalent CD20-binding molecule of the present invention can be efficiently delivered into a CD20-expressing cell for the purpose of killing the cell. Because certain multivalent CD20-binding molecules of the present invention, and compositions thereof, exhibit selective cell-targeting and efficient cellular internalization (e.g. within thirty minutes after administration), a cytotoxic cargo (such as, e.g., a cytotoxic agent, ribonucleic acid, antigen, and/or proapoptotic peptide) conjugated to a multivalent CD20-binding molecule of the present invention can be selectively and efficiently delivered into a CD20-expressing cell for the purpose of killing the cell in the presence of other cells, including other CD20-expressing cells which express lower levels of CD20 than the targeted cell(s).

D. Information Gathering for Diagnostic Functions

Certain multivalent CD20-binding molecules of the present invention, and compositions thereof, have uses in the in vitro and/or in vivo detection of specific cells, cell types, cell populations, and/or subcellular compartments of any of the foregoing. In certain embodiments, the multivalent CD20-binding molecules of the present invention, and compositions thereof, are used for both diagnosis and treatment, or for diagnosis alone. When the same cytotoxic, multivalent CD20-binding molecule is used for both diagnosis and treatment, the cytotoxic, multivalent CD20-binding molecule variant which incorporates a detection promoting agent for diagnosis may be rendered non-toxic by catalytic inactivation of its Shiga toxin effector region(s) via one or more amino acid substitutions, such as, e.g., exemplary substitutions described herein. Nontoxic forms of the cytotoxic, multivalent CD20-binding molecules of the invention that are conjugated to detection promoting agents optionally may be used for diagnostic functions, such as for companion diagnostics used in conjunction with a therapeutic regimen comprising the same or a related CD20 binding region for cell-targeting.

The ability to conjugate detection promoting agents known in the art to various cytotoxic multivalent CD20-binding molecules of the present invention provides useful compositions for the detection of cancer, tumor, and immune cells, as well as subcellular compartments of the foregoing. These diagnostic embodiments of the multivalent, CD20-binding molecules of the present invention, and compositions thereof, may be used for information gathering via various imaging techniques and assays known in the art. For example, diagnostic embodiments of the multivalent CD20-binding molecules of the present invention may be used for information gathering via imaging of intracellular organelles (e.g. endocytotic, Golgi, endoplasmic reticulum, and cytosolic compartments) of individual cancer cells, neoplastic cells, malignant tumor cells, non-malignant tumor cells, immune cells, and/or hematological cells in a patient or biopsy sample.

Various types of information may be gathered using the diagnostic embodiments of the multivalent CD20-binding molecules of the present invention, and compositions thereof, whether for diagnostic uses or other uses. This information may be useful, for example, in diagnosing CD20 positive, neoplastic cell types; determining therapeutic susceptibilities of a patient's disease; assaying the progression of anti-neoplastic therapies over time; assaying the progression of immunomodulatory therapies over time; assaying the progression of antimicrobial therapies over time; evaluating the presence of unwanted CD20+ cell types in transplantation materials; and/or evaluating the presence of residual tumor cells after surgical excision of a tumor mass.

For example, subpopulations of patients might be ascertained using information gathered using the diagnostic variants of the multivalent CD20-binding molecules of the present invention, and compositions thereof, and then individual patients could be further categorized into subpopulations based on their unique characteristic(s) revealed using those diagnostic embodiments. For example, the effectiveness of specific pharmaceuticals or therapies might be one type of criterion used to define a patient subpopulation. For example, a non-toxic diagnostic variant of a particular cytotoxic, multivalent CD20-binding molecule of the present invention, and/or composition thereof, may be used to differentiate which patients are in a class or subpopulation of patients predicted to respond positively to a cytotoxic variant of the same cytotoxic, multivalent CD20-binding molecule or other related molecule. Accordingly, associated methods for patient identification, patient stratification and diagnosis using cytotoxic, multivalent CD20-binding molecules and their non-toxic variants, as well as compositions thereof, are considered to be within the scope of the present invention.

IV. Variations in Proteinaceous Components of the Multivalent CD20-Binding Molecules of the Present Invention The skilled worker will recognize that variations may be made to the multivalent CD20-binding molecules of the present invention (and polynucleotides encoding them and/or their components) without diminishing their biological activities, e.g., by maintaining the overall structure and function of a given multivalent CD20-binding molecule. For example, some modifications may facilitate expression, facilitate purification, improve pharmacokinetic properties, improve protein stability, and/or improve immunogenicity. Such modifications are well known to the skilled worker and include, for example, a methionine added at the amino terminus to provide an initiation site, additional amino acids placed on either terminus to create conveniently located restriction sites or termination codons, and biochemical affinity tags fused to either terminus to provide for convenient detection and/or purification. A common modification to improve the immunogenicity of a polypeptide is to remove, after the production of the polypeptide, the starting methionine residue, which may be formylated during production in a bacterial host system, because, e.g., the presence of amino-terminal formylmethionine (fMet) might induce undesirable immune responses in chordates.

Also contemplated herein is the inclusion of additional amino acid residues at the amino and/or carboxy termini, such as sequences for epitope tags or other moieties. The additional amino acid residues may be used for various purposes including, e.g., to facilitate cloning, expression, post-translational modification, synthesis, purification, detection, and/or administration. Non-limiting examples of epitope tags and moieties are: chitin binding protein domains, enteropeptidase cleavage sites, Factor Xa cleavage sites, FlAsH tags, FLAG tags, green fluorescent proteins (GFP), glutathione-S-transferase moieties, HA tags, maltose binding protein domains, myc tags, polyhistidine tags, ReAsH tags, strep-tags, strep-tag II, TEV protease sites, thioredoxin domains, thrombin cleavage site, and V5 epitope tags.

In certain of the above embodiments, the multivalent CD20-binding molecule of the present invention is a variant in which there are one or more conservative amino acid substitutions introduced into a proteinaceous region(s). As used herein, the term "conservative substitution" denotes that one or more amino acids are replaced by another, biologically similar amino acid residue. Examples include substitution of amino acid residues with similar characteristics, e.g. small amino acids, acidic amino acids, polar amino acids, basic amino acids, hydrophobic amino acids and aromatic amino acids (see, for example, Table B below). An example of a conservative substitution with a residue normally not found in endogenous, mammalian peptides and proteins is the conservative substitution of an arginine or lysine residue with, for example, ornithine, canavanine, aminoethylcysteine, or another basic amino acid. For further information concerning phenotypically silent substitutions in peptides and proteins see, e.g., Bowie J et al., Science 247: 1306-10 (1990).

TABLE B

Examples of Conservative Amino Acid Substitutions

| I | II | III | IV | V | VI | VII | VIII | IX | X | XI | XII | XIII | XIV |
|---|---|---|---|---|---|---|---|---|---|---|---|---|---|
| A | D | H | C | F | N | A | C | F | A | C | A | A | D |
| G | E | K | I | W | Q | G | M | H | C | D | C | C | E |
| P | Q | R | L | Y | S | I | P | W | F | E | D | D | G |
| S | N |   | M |   | T | L |   | Y | G | H | G | E | K |
| T |   |   | V |   |   | V |   |   | H | K | N | G | P |
|   |   |   |   |   |   |   |   |   | I | N | P | H | Q |
|   |   |   |   |   |   |   |   |   | L | Q | S | K | R |
|   |   |   |   |   |   |   |   |   | M | R | T | N | S |
|   |   |   |   |   |   |   |   |   | R | S | V | Q | T |
|   |   |   |   |   |   |   |   |   | T | T |   | R |   |
|   |   |   |   |   |   |   |   |   | V |   |   | S |   |
|   |   |   |   |   |   |   |   |   | W |   |   | P |   |
|   |   |   |   |   |   |   |   |   | Y |   |   | T |   |

In the conservative substitution scheme in Table B, exemplary conservative substitutions of amino acids are grouped by physicochemical properties—I: neutral, hydrophilic; II: acids and amides: III: basic; IV: hydrophobic; V: aromatic, bulky amino acids, VI hydrophilic uncharged, VII aliphatic uncharged, VIII non-polar uncharged, IX cycloalkenyl-associated, X hydrophobic, XI polar, XII small, XIII turn-permitting, and XIV flexible. For example, conservative amino acid substitutions include the following: 1) S may be substituted for C; 2) M or L may be substituted for F; 3) Y may be substituted for M; 4) Q or E may be substituted for K; 5) N or Q may be substituted for H; and 6) H may be substituted for N.

In certain embodiments, a multivalent CD20-binding molecule of the present invention or multivalent CD20-binding molecule composition of the present invention may comprise a protein that has, at most, 20, 15, 10, 9, 8, 7, 6, 5, 4, 3, 2, or 1 amino acid substitution(s) compared to a protein sequence recited herein, as long as the multivalent CD20-binding molecule retains the requisite biological activity(ies).

Variants of multivalent CD20-binding molecules provided herein are within the scope of the present invention as a result of changing a proteinaceous component of the multivalent CD20-binding molecule of the present invention by altering one or more amino acids or deleting or inserting one or more amino acids, such as, e.g., within a CD20 binding region or Shiga toxin effector region, in order to achieve desired properties, such as, e.g., changed cytotoxicity, changed cytostatic effects, changed immunogenicity, and/or changed serum half-life. A polypeptide component of a multivalent CD20-binding molecule of the present invention or multivalent CD20-binding molecule composition of the present invention may further be with or without a signal sequence. In certain embodiments, a proteinaceous component of a multivalent CD20-binding molecule of the present invention or multivalent CD20-binding molecule composition of the present invention shares at least 85%, 90%, 95%, 96%, 97%, 98%, 99% or more amino acid sequence identity to any one of the amino acid sequences of a molecule recited herein, as long as the proteinaceous component retains, alone and/or as a component of a multivalent CD20-binding molecule of the present invention, measurable biological activity, such as cytotoxicity, extracellular CD20 target biomolecule binding, enzymatic catalysis, or subcellular routing.

In certain embodiments, a proteinaceous component of a multivalent CD20-binding molecule of the present invention may comprise functional fragments or variants of a polypeptide region of the invention that have, at most, 20, 15, 10, 9, 8, 7, 6, 5, 4, 3, 2, or 1 amino acid substitution(s) compared to a polypeptide sequence recited herein, as long as the substituted protein retains measurable biological activity alone and/or as a component of a multivalent CD20-binding molecule of the present invention.

In certain embodiments, a proteinaceous component of a multivalent CD20-binding molecule of a composition of the present invention shares at least 85%, 90%, 95%, 96%, 97%, 98%, 99% or more amino acid sequence identity to any one of the amino acid sequences of a protein recited herein, as long as the protein retains measurable biological activity, such as cytotoxicity, extracellular CD20 target biomolecule binding, enzymatic catalysis, or subcellular routing. The CD20 binding regions of a multivalent CD20-binding molecule may differ from the amino acid sequences of a CD20 binding region recited herein, as long as the CD20-binding region retains binding functionality to an extracellular part of CD20. Binding functionality will most likely be retained if the amino acid sequences of the CDRs or ABRs are identical. For example, a multivalent CD20-binding molecule is within the claim scope wherein the CD20-binding region comprises one or more CD20 binding regions comprising or consisting essentially of 85% amino acid identity to a CD20 binding region recited herein which for the purposes of determining the degree of amino acid identity, the amino acid residues that form the CDRs or ABRs are disregarded. Extracellular CD20 binding functionality can be determined by the skilled worker using standard techniques.

The invention further provides variants of the multivalent CD20-binding molecules of the present invention, wherein the Shiga toxin effector region differs from a naturally occurring Shiga toxin A Subunit by up to 1, 2, 3, 4, 5, 6, 7, 8, 9, 10, 15, 20, 25, 30, 35, 40 or more amino acid residues (but by no more than that which retains at least 85%, 90%, 95%, 99% or more amino acid sequence identity). Thus, a polypeptide region derived from an A Subunit of a member of the Shiga toxin family may comprise additions, deletions, truncations, or other alterations from the original sequence as long as at least 85%, 90%, 95%, 99% or more amino acid sequence identity is maintained to a naturally occurring Shiga toxin A Subunit.

Accordingly, in certain embodiments, the Shiga toxin effector region comprises or consists essentially of amino acid sequences having at least 55%, 60%, 65%, 70%, 75%, 80%, 85%, 90%, 95%, 97%, 98%, 99%, 99.5% or 99.7% overall sequence identity to a naturally occurring Shiga toxin A Subunit, such as SLT-1A (SEQ ID NO: 1), StxA (SEQ ID NO:2), and/or SLT-2A (SEQ ID NO:3).

Optionally, either a full-length or a truncated version of the Shiga toxin A Subunit may comprise one or more mutations (e.g. substitutions, deletions, insertions or inversions). It is preferred in certain embodiments of the invention that the Shiga toxin effector region has sufficient sequence identity to a naturally occurring Shiga toxin A Subunit to retain cytotoxicity after entry into a cell, either by well-known methods of host cell transformation, transfection, infection or induction, or by internalization mediated by the cell targeting CD20 binding region linked with the Shiga toxin effector region. The most critical residues for enzymatic activity and/or cytotoxicity in the Shiga toxin A Subunits have been mapped to the following residue-positions: aspargine-75, tyrosine-77, glutamate-167, arginine-170, and arginine-176 among others (Di R et al., Toxicon 57: 525-39 (2011)). In any one of the embodiments of the invention, the Shiga toxin effector region may preferably but not necessarily maintain one or more conserved amino acids at positions, such as those found at positions 77, 167, 170, and 176 in StxA, SLT-1A, or the equivalent conserved position in other members of the Shiga toxin family which are typically required for cytotoxic activity. The capacity of a cytotoxic multivalent, CD20-binding molecule of the present invention to cause cell death, e.g. its cytotoxicity, may be measured using any one or more of a number of assays well known in the art.

In certain embodiments of the multivalent CD20-binding molecules of the present invention, one or more amino acid residues may be mutated, inserted, or deleted in order to increase the enzymatic activity of one or more of the molecule's Shiga toxin effector regions. For example, mutating residue-position alanine-231 in Stx1A to glutamate increased Stx1A's enzymatic activity in vitro (Suhan M, Hovde C, Infect Immun 66: 5252-9 (1998)).

In certain embodiments of the multivalent CD20-binding molecules of the present invention, one or more amino acid residues may be mutated or deleted in order to reduce or eliminate catalytic and/or cytotoxic activity of one or more of the molecule's Shiga toxin effector regions. The catalytic and/or cytotoxic activity of the A Subunits of members of the Shiga toxin family may be reduced or eliminated by mutation or truncation. The positions labeled tyrosine-77, glutamate-167, arginine-170, tyrosine-114, and tryptophan-203 have been shown to be important for the catalytic activity of Stx, Stx1, and Stx2. Mutating both glutamate-167 and arginine-170 eliminated the enzymatic activity of Slt-I A1 in a cell-free ribosome inactivation assay. In another approach using de novo expression of Slt-I A1 in the endoplasmic reticulum, mutating both glutamate-167 and arginine-170 or truncating it to residues 1-239 eliminated Slt-I A1 fragment cytotoxicity at that expression level.

In certain embodiments, the Shiga toxin effector region(s) may be altered to change its enzymatic activity and/or cytotoxicity as long as the Shiga toxin effector region(s) retains one or more other Shiga toxin effector functions. This change may or may not result in a change in the cytotoxicity of a molecule of which the altered Shiga toxin effector region(s) is a component. Possible alterations include mutations to the Shiga toxin effector region(s) selected from the group consisting of: a truncation, deletion, inversion, insertion, rearrangement, and substitution.

The cytotoxicity of the A Subunits of members of the Shiga toxin family may be altered, reduced, or eliminated by mutation or truncation. The positions labeled tyrosine-77, glutamate-167, arginine-170, tyrosine-114, and tryptophan-203 have been shown to be important for the catalytic activity of Stx, Stx1, and Stx2. Mutating both glutamate-167 and arginine-170 eliminated the enzymatic activity of Slt-I A1 in a cell-free ribosome inactivation assay. In another approach using de novo expression of Slt-I A1 in the endoplasmic reticulum, mutating both glutamate-167 and arginine-170 eliminated Slt-I A1 fragment cytotoxicity at that expression level. A truncation analysis demonstrated that a fragment of StxA from residues 75 to 268 still retains significant enzymatic activity in vitro. A truncated fragment of Slt-I A1 containing residues 1-239 displayed significant enzymatic activity in vitro and cytotoxicity by de novo expression in the cytosol. Expression of a Slt-I A1 fragment truncated to residues 1-239 in the endoplasmic reticulum was not cytotoxic because the Slt-I A1 truncation could not retrotranslocate to the cytosol.

The most critical residues for enzymatic activity and/or cytotoxicity in the Shiga toxin A Subunits have been mapped to the following residue-positions: asparagine-75, tyrosine-77, glutamate-167, arginine-170, and arginine-176 among others. In particular, a double-mutant construct of Stx2A containing glutamate-E167-to-lysine and arginine-176-to-lysine mutations was completely inactivated; whereas, many single mutations in Stx1 and Stx2 showed a 10-fold reduction in cytotoxicity. Further, truncation of Stx1A to 1-239 or 1-240 reduced its cytotoxicity, and similarly, truncation of Stx2A to a conserved hydrophobic residue reduced its cytotoxicity.

The most critical residues for binding eukaryotic ribosomes and/or eukaryotic ribosome inhibition in the Shiga toxin A Subunit have been mapped to the following residue-positions arginine-172, arginine-176, arginine-179, arginine-188, tyrosine-189, valine-191, and leucine-233 among others.

Shiga-like toxin 1 A Subunit truncations are catalytically active, capable of enzymatically inactivating ribosomes in vitro, and cytotoxic when expressed within a cell. The smallest Shiga toxin A Subunit fragment exhibiting full enzymatic activity is a polypeptide composed of residues 1-239 of Slt1A. Although the smallest fragment of the Shiga toxin A Subunit reported to retain substantial catalytic activity was residues 75-247 of StxA, a StxA truncation expressed de novo within a eukaryotic cell requires only up to residue 240 to reach the cytosol from the endoplasmic reticulum and exert catalytic inactivation of ribosomes.

In certain multivalent CD20-binding molecules of the present invention which comprise a Shiga toxin effector region derived from SLT-1A (SEQ ID NO: 1) or StxA (SEQ ID NO:2), these mutational changes include substitution of the asparagine at position 75, tyrosine at position 77, tyrosine at position 114, glutamate at position 167, arginine at position 170, arginine at position 176, and/or substitution of the tryptophan at position 203. Examples of such substitutions will be known to the skilled worker based on the prior art, such as asparagine at position 75 to alanine, tyrosine at position 77 to serine, substitution of the tyrosine at position 114 to serine, substitution of the glutamate at position 167 to aspartate, substitution of the arginine at position 170 to alanine, substitution of the arginine at position 176 to lysine, and/or substitution of the tryptophan at position 203 to alanine.

In certain embodiments, the multivalent CD20-binding molecule of the present invention is de-immunized (see e.g., WO 2015/113005 and WO 2015/113007). In certain embodiments, the de-immunized, multivalent CD20-binding molecule of the present invention comprises the protein shown in any one of SEQ ID NOs: 49-51, 63-64, 75-76, 81-82, 87-88, 93-94, 99-100, 105-106, 111-112, 117-118, 122-124, 131-132, 139-140, 144-145, 149-150, 155-156, 161-162, 167-168, 171, 174, 178-180, 192-193, 204-205, 210-211, 216-217, 222-223, 228-229, 234-235, 240-241, 246-247, 251-253, 260-261, 268-269, 273-274, 278-279, 284-285, 290, and 296; and optionally, the protein further comprises an amino-terminal methionine residue. In certain further embodiments, the multivalent CD20-binding molecule of the present invention comprises or consists essentially of two proteins, each protein selected from any one of the polypeptides shown in SEQ ID NOs: 49-51, 63-64, 75-76, 81-82, 87-88, 93-94, 99-100, 105-106, 111-112, 117-118, 122-124, 131-132, 139-140, 144-145, 149-150, 155-156, 161-162, 167-168, 171, 174, 178-180, 192-193, 204-205, 210-211, 216-217, 222-223, 228-229, 234-235, 240-241, 246-247, 251-253, 260-261, 268-269, 273-274, 278-279, 284-285, 290, and 296; and optionally, each protein further comprises an amino-terminal methionine residue. In certain further embodiments, the protein is selected from any one of the proteins shown in SEQ ID NOs: 49-51, 63-64, 75-76, 81-82, 87-88, 93-94, 99-100, 105-106, 111-112, 117-118, 122-124, 131-132, 139-140, 144-145, 149-150, 155-156, 161-162, 167-168, 171, and 174, and further comprises a disulfide bond involving a cysteine residue at the position selected from the group consisting of: 242, 482, 483, 484, 490, 491, 492, 493, 494, 495, 499, 500, 501, 502, 503, 504, 505, 510, 511, 512, 513, and 521.

Multivalent CD20-binding molecules of the present invention may optionally be conjugated to one or more additional agents, such as therapeutic and/or diagnostic agents known in the art, including such agents as described herein.

V. Production, Manufacture, and Purification of Multivalent CD20-Binding Molecules of the Present Invention and Compositions Thereof The multivalent CD20-binding molecules of the present invention, and compositions thereof, may be produced using biochemical engineering techniques well known to those of skill in the art. For example, multivalent CD20-binding molecules of the present invention, and compositions thereof, may be manufactured by standard synthetic methods, by use of recombinant expression systems, or by any other suitable method. The multivalent CD20-binding molecules of the present invention may be produced as fusion proteins, chemically coupled conjugates, and/or combinations thereof, such as, e.g., a fusion protein component covalently linked to one or more other components of the multivalent CD20-binding molecule of the invention. Thus, the multivalent CD20-binding molecules of the present invention may be synthesized in a number of ways, including, e.g. methods comprising: (1) synthesizing a polypeptide or polypeptide component of a multivalent CD20-binding molecule of the invention using standard solid-phase or liquid-phase methodology, either stepwise or by fragment assembly, and isolating and purifying the final proteinaceous compound product; (2) expressing a polynucleotide that encodes a polypeptide or polypeptide component of a multivalent CD20-binding molecule of the invention in a host cell and recovering the expression product from the host cell or host cell culture; or (3) cell-free in vitro expression of a polynucleotide encoding a polypeptide or polypeptide component of a multivalent CD20-binding molecule of the invention, and recovering the expression product; or by any combination of the methods of (1), (2) or (3) to obtain fragments of a proteinaceous component of a multivalent CD20-binding molecule of the invention, subsequently joining (e.g. ligating) the fragments to obtain the proteinaceous component of a multivalent CD20-binding molecule of the invention, and purifying or recovering that proteinaceous component. For example, polypeptide and/or peptide components may be ligated together using coupling reagents, such as, e.g., N,N'-dicyclohexycarbodiimide and N-ethyl-5-phenyl-isoxazolium-3'-sulfonate (Woodward's reagent K).

It may be preferable to synthesize a polypeptide or polypeptide component of a multivalent CD20-binding molecule of the present invention by means of solid-phase or liquid-phase peptide synthesis. Multivalent CD20-binding molecules of the present invention may suitably be manufactured by standard synthetic methods. Thus, polypeptides may be synthesized by, e.g. methods comprising synthesizing the polypeptide by standard solid-phase or liquid-phase methodology, either stepwise or by fragment assembly, and isolating and purifying the final polypeptide product. In this context, reference may be made to WO 1998/11125 or, inter alia, Fields G et al., *Principles and Practice of Solid-Phase Peptide Synthesis* (Synthetic Peptides, Grant G, ed., Oxford University Press, U.K., 2nd ed., 2002) and the synthesis examples therein.

Multivalent CD20-binding molecules of the present invention may be prepared (produced and purified) using recombinant techniques well known in the art. In general, methods for preparing proteins by culturing host cells transformed or transfected with a vector comprising the encoding polynucleotide and recovering the protein from cell culture are described in, e.g. Sambrook J et al., *Molecular Cloning: A Laboratory Manual* (Cold Spring Harbor Laboratory Press, NY, U.S., 1989); Dieffenbach C et al., *PCR Primer: A Laboratory Manual* (Cold Spring Harbor Laboratory Press, N.Y., U.S., 1995). Any suitable host cell may be used to produce a proteinaceous component of a multivalent CD20-binding molecule of the present invention and/or a multivalent CD20-binding protein of the invention. Host cells may be cells stably or transiently transfected, transformed, transduced or infected with one or more expression vectors which drive expression of a multivalent CD20-binding protein of the invention and/or a proteinaceous component of a multivalent CD20-binding molecule of the present invention. In addition, a multivalent CD20-binding protein of the present invention may be produced by modifying the polynucleotide encoding the multivalent CD20-binding molecule of the invention, or proteinaceous component thereof, described herein that result in altering one or more amino acids or deleting or inserting one or more amino acids in order to achieve desired properties, such as changed cytotoxicity, changed cytostatic effects, changed immunogenicity, and/or changed serum half-life.

There are a wide variety of expression systems which may be chosen to produce a multivalent CD20-binding protein of the invention and/or a proteinaceous component of a multivalent CD20-binding molecule of the present invention. For example, host organisms for expression of a multivalent CD20-binding protein of the invention and/or a proteinaceous component of a multivalent CD20-binding molecule of the present invention include prokaryotes, such as *E. coli* and *B. subtilis*, eukaryotic cells, such as yeast and filamentous fungi (like *S. cerevisiae*, *P. pastoris*, *A. awamori*, and *K. lactis*), algae (like *C. reinhardtii*), insect cell lines, mammalian cells (like CHO cells), plant cell lines, and eukaryotic organisms such as transgenic plants (like *A. thaliana* and *N. benthamiana*) (see e.g., Pack P, Plückthun A, *Biochemistry (Mosc)* 31: 1579-84 (1992); Blanco B et al., *J Immunol* 171: 1070-7 (2003); Sanchez-Arevalo Lobo V et al., *Int J Cancer* 119: 455-62 (2006); Mazor Y et al., *Nat Biotechnol* 25: 563-5 (2007); Schoonooghe S et al., *BMC Biotechnol* 9: 70 (2009); Chan C et al., *PLoS One* 5: e10261 (2010); Cuesta M et al., *Trends Biotechnol* 28: 355-62 (2010); Gershenson A. Gierasch L. *Curr Opin Struct Biol* 21: 32-41 (2011); Hutchins B et al., *J Mol Biol* 406: 595-603 (2011); Powers G et al., *Methods Mol Biol* 907: 699-712 (2012); Wang L et al., *Protein Eng Des Sel* 26: 417-23 (2013); Blanco-Toribio A et al., *Microb Cell Fact* 13: 116 (2014); Spadiut O et al., *Trends Biotechnol* 32: 54-60 (2014); Turki I et al., *Mol Immunol* 57: 66-73 (2014); Blanco-Toribio A et al., *AMB Expr* 5: 45 (2015)); Nuñez-Prado N et al., *Drug Discov Today* 20: 588-94 (2015)).

Accordingly, the present invention also provides methods for producing a multivalent CD20-binding molecule of the present invention according to above recited methods and using (i) a polynucleotide encoding part or all of a proteinaceous component of a multivalent CD20-binding molecule of the present invention and/or a multivalent CD20-binding protein of the present invention, (ii) an expression vector comprising at least one polynucleotide of the invention capable of encoding part or all of a multivalent CD20-binding molecule of the present invention and/or a multivalent CD20-binding protein of the present invention when introduced into a suitable host cell or cell-free expression system, and/or (iii) a host cell comprising a polynucleotide or expression vector of the present invention.

When a protein is expressed using recombinant techniques in a host cell or cell-free system, it is advantageous to separate (or purify) the desired protein away from other components, such as host cell factors, in order to obtain preparations that are of high purity or are substantially homogeneous. Purification can be accomplished by methods well known in the art, such as centrifugation techniques, extraction techniques, chromatographic and fractionation techniques (e.g. size separation by gel filtration, charge separation by ion-exchange column, hydrophobic interaction chromatography, reverse phase chromatography, chromatography on silica or cation-exchange resins such as diethylaminoethyl (DEAE) resins and the like, chromatofocusing, and Protein A Sepharose chromatography to remove contaminants), and precipitation techniques (e.g. ethanol precipitation or ammonium sulfate precipitation). Any number of biochemical purification techniques may be used to increase the purity of a multivalent CD20-binding molecule of the present invention. In certain embodiments, the multivalent CD20-binding molecules of the present invention may optionally be purified in homo-multimeric forms (e.g. a protein complex of two or more identical, CD20-binding proteins) or in hetero-multimeric forms (e.g. a protein complex of two or more non-identical CD20-binding proteins).

In the Examples below are descriptions of non-limiting examples of methods for producing a multivalent CD20-binding molecule of the present invention and compositions thereof, as well as specific but non-limiting aspects of production of certain, disclosed, exemplary, cytotoxic, multivalent CD20-binding molecules of the present invention.

VI. Molecules of the Present Invention Immobilized on Solid Substrates

Certain embodiments of the present invention include a molecule of the present invention (e.g., a multivalent CD20-binding molecule or any effector fragment thereof) immobilized on a solid substrate. Solid substrates contemplated herein include, but are not limited to, microbeads, nanoparticles, polymers, matrix materials, microarrays, microtiter plates, or any solid surface known in the art (see e.g. U.S. Pat. No. 7,771,955). In accordance with these embodiments, a molecule of the present invention may be covalently or non-covalently linked to a solid substrate, such as, e.g., a bead, particle, or plate, using techniques known to the skilled worker (see e.g. Jung Y et al., *Analyst* 133: 697-701 (2008)). Immobilized molecules of the invention may be used for screening applications using techniques known in the art (see e.g. Bradbury A et al., *Nat Biotechnol* 29: 245-54 (2011); Sutton C, *Br J Pharmacol* 166: 457-75 (2012); Diamante L et al., *Protein Eng Des Sel* 26: 713-24 (2013); Houlihan G et al., *J Immunol Methods* 405: 47-56 (2014)).

Non-limiting examples of solid substrates to which a molecule of the present invention may be immobilized on include: microbeads, nanoparticles, polymers, nanopolymers, nanotubes, magnetic beads, paramagnetic beads, superparamagnetic beads, streptavidin coated beads, reverse-phase magnetic beads, carboxy terminated beads, hydrazine terminated beads, silica (sodium silica) beads, iminodiacetic acid (IDA)-modified beads, aldehyde-modified beads, epoxy-activated beads, diaminodipropylamine (DADPA)-modified beads (beads with primary amine surface group), biodegradable polymeric beads, polystyrene substrates, amino-polystyrene particles, carboxyl-polystyrene particles, epoxy-polystyrene particles, dimethylamino-polystyrene particles, hydroxy-polystyrene particles, colored particles, flow cytometry particles, sulfonate-polystyrene particles, nitrocellulose surfaces, reinforced nitrocellulose membranes, nylon membranes, glass surfaces, activated glass surfaces, activated quartz surfaces, polyvinylidene difluoride (PVDF) membranes, polyacrylamide-based substrates, poly-vinyl chloride substrates, poly-methyl methacrylate substrates, poly(dimethyl siloxane) substrates, and photopolymers which contain photoreactive species (such as, e.g., nitrenes, carbenes, and ketyl radicals) capable of forming covalent linkages. Other examples of solid substrates to which a molecule of the present invention may be immobilized on are commonly used in molecular display systems, such as, e.g., cellular surfaces, phages, and virus particles.

VII. Pharmaceutical and Diagnostic Compositions Comprising a Multivalent CD20-Binding Molecule of the Present Invention The present invention provides multivalent CD20-binding molecules for use, alone or in combination with one or more additional therapeutic agents, in a pharmaceutical composition, for treatment or prophylaxis of conditions, diseases, disorders, or symptoms described in further detail below (e.g., cancers, malignant tumors, non-malignant tumors, growth abnormalities, and immune disorders). The present invention further provides pharmaceutical compositions comprising a multivalent CD20-binding molecule of the present invention, or a pharmaceutically acceptable salt or solvate thereof, according to the invention, together with at least one pharmaceutically acceptable carrier, excipient, or vehicle. In certain embodiments, the pharmaceutical composition of the present invention may comprise multivalent CD20-binding molecules that are homo-multimeric and/or hetero-multimeric. The pharmaceutical compositions of the present invention are useful in methods of treating, ameliorating, or preventing a disease, condition, disorder, or symptom described in further detail below. Each such disease, condition, disorder, or symptom is envisioned to be a separate embodiment with respect to uses of a pharmaceutical composition according to the invention. The invention further provides pharmaceutical compositions for use in at least one method of treatment according to the invention, as described in more detail below.

As used herein, the terms "patient" and "subject" are used interchangeably to refer to any organism, commonly vertebrates such as humans and animals, which presents symptoms, signs, and/or indications of at least one disease, disorder, or condition. These terms include mammals such as the non-limiting examples of primates, livestock animals (e.g. cattle, horses, pigs, sheep, goats, etc.), companion animals (e.g. cats, dogs, etc.) and laboratory animals (e.g. mice, rabbits, rats, etc.).

As used herein, "treat," "treating," or "treatment" and grammatical variants thereof refer to an approach for obtaining beneficial or desired clinical results. The terms may refer to slowing the onset or rate of development of a condition, disorder or disease, reducing or alleviating symptoms associated with it, generating a complete or partial regression of the condition, or some combination of any of the above. For the purposes of this invention, beneficial or desired clinical results include, but are not limited to, reduction or alleviation of symptoms, diminishment of extent of disease, stabilization (e.g. not worsening) of state of disease, delay or slowing of disease progression, amelioration or palliation of the disease state, and remission (whether partial or total), whether detectable or undetectable. "Treat," "treating," or "treatment" can also mean prolonging survival relative to expected survival time if not receiving treatment. A subject (e.g. a human) in need of treatment may thus be a subject already afflicted with the disease or disorder in question. The terms "treat," "treating," or "treatment" includes inhibition or reduction of an increase in severity of a pathological state or symptoms relative to the absence of treatment, and is not necessarily meant to imply complete cessation of the relevant disease, disorder, or condition. With regard to tumors and/or cancers, treatment includes reductions in overall tumor burden and/or individual tumor size.

As used herein, the terms "prevent," "preventing," "prevention" and grammatical variants thereof refer to an approach for preventing the development of, or altering the pathology of, a condition, disease, or disorder. Accordingly, "prevention" may refer to prophylactic or preventive measures. For the purposes of this invention, beneficial or desired clinical results include, but are not limited to, prevention or slowing of symptoms, progression or development of a disease, whether detectable or undetectable. A subject (e.g. a human) in need of prevention may thus be a subject not yet afflicted with the disease or disorder in question. The term "prevention" includes slowing the onset of disease relative to the absence of treatment, and is not necessarily meant to imply permanent prevention of the relevant disease, disorder or condition. Thus "preventing" or "prevention" of a condition may in certain contexts refer to reducing the risk of developing the condition, or preventing or delaying the development of symptoms associated with the condition.

As used herein, an "effective amount" or "therapeutically effective amount" is an amount or dose of a composition (e.g. a therapeutic composition, compound, or agent) that produces at least one desired therapeutic effect in a subject, such as preventing or treating a target condition or beneficially alleviating a symptom associated with the condition. The most desirable therapeutically effective amount is an amount that will produce a desired efficacy of a particular treatment selected by one of skill in the art for a given subject in need thereof. This amount will vary depending upon a variety of factors understood by the skilled worker, including but not limited to the characteristics of the therapeutic composition (including activity, pharmacokinetics, pharmacodynamics, and bioavailability), the physiological condition of the subject (including age, sex, disease type, disease stage, general physical condition, responsiveness to a given dosage, and type of medication), the nature of the pharmaceutically acceptable carrier or carriers in the formulation, and the route of administration. One skilled in the clinical and pharmacological arts will be able to determine a therapeutically effective amount through routine experimentation, namely by monitoring a subject's response to administration of a composition and adjusting the dosage accordingly (see e.g. *Remington: The Science and Practice of Pharmacy* (Gennaro A, ed., Mack Publishing Co., Easton, Pa., U.S., 19th ed., 1995)).

Diagnostic compositions comprise a multivalent CD20-binding molecule of the present invention and one or more detection promoting agents. When producing or manufacturing a diagnostic composition of the present invention, a multivalent CD20-binding molecule of the invention may be directly or indirectly linked to one or more detection promoting agents. There are numerous standard techniques known to the skilled worker for incorporating, affixing, and/or conjugating various detection promoting agents to proteins or proteinaceous components of molecules, especially to immunoglobulins and immunoglobulin-derived domains.

Diagnostic compositions of the present invention comprise a multivalent CD20-binding molecule of the present invention and one or more detection promoting agents. Various detection promoting agents are known in the art, such as isotopes, dyes, colorimetric agents, contrast enhancing agents, fluorescent agents, bioluminescent agents, and magnetic agents. These agents may be associated with, linked to, and/or incorporated within the multivalent CD20-binding molecule at any suitable position. For example, the linkage or incorporation of the detection promoting agent may be via an amino acid residue(s) of the multivalent CD20-binding molecule of the present invention or via some type of linkage known in the art, including via linkers and/or chelators. The association of the detection promoting agent with a multivalent CD20-binding molecule of a diagnostic composition of the present invention is in such a way to enable the detection of the presence of the multivalent CD20-binding molecule, and a diagnostic composition thereof, in a screen, assay, diagnostic procedure, and/or imaging technique.

There are numerous detection promoting agents known to the skilled worker which can be operably associated or linked to the multivalent CD20-binding molecules of the present invention for information gathering methods, such as for diagnostic and/or prognostic applications to diseases, disorders, or conditions of an organism. For example, detection promoting agents include image enhancing contrast agents, such as fluorescent dyes (e.g. Alexa680, indocyanine green, and Cy5.5), isotopes and radionuclides, such as $^{11}C$, $^{13}N$, $^{15}O$, $^{18}F$, $^{32}P$, $^{51}Mn$, $^{52m}Mn$, $^{52}Fe$, $^{55}Co$, $^{62}Cu$, $^{64}Cu$, $^{67}Cu$, $^{67}Ga$, $^{68}Ga$, $^{72}As$, $^{73}Se$, $^{75}Br$, $^{76}Br$, $^{82m}Rb$, $^{83}Sr$, $^{86}Y$, $^{90}Y$, $^{89}Zr$, $^{94m}Tc$, $^{94}Tc$, $^{99m}Tc$, $^{110}In$, $^{111}In$, $^{120}I$, $^{123}I$, $^{124}I$, $^{125}I$, $^{131}I$, $^{154}Gd$, $^{155}Gd$, $^{156}Gd$, $^{157}Gd$, $^{158}Gd$, $^{177}Lu$, $^{186}Re$, $^{188}Re$, and $^{223}R$; paramagnetic ions, such as chromium (III), manganese (II), iron (III), iron (II), cobalt (II), nickel (II), copper (II), neodymium (III), samarium (III), ytterbium (III), gadolinium (III), vanadium (II), terbium (III), dysprosium (III), holmium (III) or erbium (III); metals, such as lanthanum (III), gold (III), lead (II), and bismuth (III); ultrasound-contrast enhancing agents, such as liposomes; radiopaque agents, such as barium, gallium, and thallium compounds. Detection promoting agents may be incorporated directly or indirectly by using an intermediary functional group, such as chelators like 2-benzyl DTPA, PAMAM, NOTA, DOTA, TETA, analogs thereof, and functional equivalents of any of the foregoing.

There are numerous imaging approaches in the art which are known to the skilled worker, such as non-invasive in vivo imaging techniques commonly used in the medical arena, for example: computed tomography imaging (CT scanning), optical imaging (including direct, fluorescent, and bioluminescent imaging), magnetic resonance imaging (MRI), positron emission tomography (PET), single-photon emission computed tomography (SPECT), ultrasound, and x-ray computed tomography imaging.

The phrase "diagnostically sufficient amount" refers to an amount that provides adequate detection and accurate measurement for information gathering purposes by the particular assay or diagnostic technique utilized. Generally, the diagnostically sufficient amount for whole organism, in vivo, diagnostic use will be a non-cumulative dose of between 0.001 mg to 1 mg of the detection promoting agent linked to multivalent CD20-binding molecule per kilogram (kg) of subject per subject (mg/kg). Typically, the amount of multivalent CD20-binding molecule of the present invention used in these information gathering methods will be as low as possible provided that it is still a diagnostically sufficient amount. For example, for in vivo detection in an organism, the amount of multivalent CD20-binding molecule or diagnostic composition of the present invention administered to a subject will be as low as feasibly possible.

Production or Manufacture of a Pharmaceutical and/or Diagnostic Composition Comprising a Multivalent CD20-Binding Molecule of the Present Invention and/or a Composition Thereof Pharmaceutically acceptable salts or solvates of any of the multivalent CD20-binding molecules of the present invention are within the scope of the present invention.

The term "solvate" in the context of the present invention refers to a complex of defined stoichiometry formed between a solute (e.g. in casu, a proteinaceous compound or pharmaceutically acceptable salt thereof according to the invention) and a solvent. The solvent in this connection may, for example, be water, ethanol or another pharmaceutically acceptable, typically small-molecular organic species, such as, but not limited to, acetic acid or lactic acid. When the solvent in question is water, such a solvate is normally referred to as a hydrate.

Multivalent CD20-binding molecules of the present invention, or salts thereof, may be formulated as pharmaceutical compositions prepared for storage or administration, which typically comprise a therapeutically effective amount of a molecule or composition of the present invention, or a salt thereof, in a pharmaceutically acceptable carrier. The term "pharmaceutically acceptable carrier" includes any of the standard pharmaceutical carriers. Pharmaceutically acceptable carriers for therapeutic use are well known in the pharmaceutical art, and are described, for example, in *Remington's Pharmaceutical Sciences* (Mack Publishing Co. (A. Gennaro, ed., 1985)). As used herein, "pharmaceutically acceptable carrier" includes any and all physiologically acceptable, i.e. compatible, solvents, dispersion media, coatings, antimicrobial agents, isotonic, and absorption delaying agents, and the like. Pharmaceutically acceptable carriers or diluents include those used in formulations suitable for oral, rectal, nasal or parenteral (including subcutaneous, intramuscular, intravenous, intradermal, and transdermal) administration. Exemplary pharmaceutically acceptable carriers include sterile aqueous solutions or dispersions and sterile powders for the extemporaneous preparation of sterile injectable solutions or dispersions. Examples of suitable aqueous and nonaqueous carriers that may be employed in the pharmaceutical compositions of the invention include water, ethanol, polyols (such as glycerol, propylene glycol, polyethylene glycol, and the like), and suitable mixtures thereof, vegetable oils, such as olive oil, and injectable organic esters, such as ethyloleate. Proper fluidity can be maintained, for example, by the use of coating materials, such as lecithin, by the maintenance of the required particle size in the case of dispersions, and by the use of surfactants. In certain embodiments, the carrier is suitable for intravenous, intramuscular, subcutaneous, parenteral, spinal or epidermal administration (e.g. by injection or infusion). Depending on selected route of administration, the multivalent CD20-binding molecule of the present invention or other pharmaceutical component may be coated in a material intended to protect the multivalent CD20-binding molecule and/or a compound thereof from the action of low pH and other natural inactivating conditions to which the active multivalent CD20-binding molecule of the invention may encounter when administered to a patient by a particular route of administration.

The formulations of the pharmaceutical compositions of the present invention may conveniently be presented in unit dosage form and may be prepared by any of the methods well known in the art of pharmacy. In such form, the composition is divided into unit doses containing appropriate quantities of the active component. The unit dosage form can be a packaged preparation, the package containing discrete quantities of the preparations, for example, packeted tablets, capsules, and powders in vials or ampoules. The unit dosage form can also be a capsule, cachet, or tablet itself, or it can be the appropriate number of any of these packaged forms. It may be provided in single dose injectable form, for example in the form of a pen. Compositions may be formulated for any suitable route and means of administration. Subcutaneous or transdermal modes of administration may be particularly suitable for pharmaceutical compositions and therapeutic molecules described herein.

The pharmaceutical compositions of the present invention may also contain adjuvants such as preservatives, wetting agents, emulsifying agents and dispersing agents. Preventing the presence of microorganisms may be ensured both by sterilization procedures, and by the inclusion of various antibacterial and antifungal agents, for example, paraben, chlorobutanol, phenol sorbic acid, and the like. Isotonic agents, such as sugars, sodium chloride, and the like into the compositions, may also be desirable. In addition, prolonged absorption of the injectable pharmaceutical form may be brought about by the inclusion of agents which delay absorption such as, aluminum monostearate and gelatin.

A pharmaceutical composition of the present invention also optionally includes a pharmaceutically acceptable antioxidant. Exemplary pharmaceutically acceptable antioxidants are water soluble antioxidants such as ascorbic acid, cysteine hydrochloride, sodium bisulfate, sodium metabisulfite, sodium sulfite and the like; oil-soluble antioxidants, such as ascorbyl palmitate, butylated hydroxyanisole (BHA), butylated hydroxytoluene (BHT), lecithin, propyl-gallate, alpha-tocopherol, and the like; and metal chelating agents, such as citric acid, ethylenediamine tetraacetic acid (EDTA), sorbitol, tartaric acid, phosphoric acid, and the like.

In another aspect, the present invention provides pharmaceutical compositions comprising one or a combination of different, multivalent CD20-binding molecules of the present invention, or an ester, salt or amide of any of the foregoing, and at least one pharmaceutically acceptable carrier.

Therapeutic compositions are typically sterile and stable under the conditions of manufacture and storage. The composition may be formulated as a solution, microemulsion, liposome, or other ordered structure suitable to high drug concentration. The carrier may be a solvent or dispersion medium containing, for example, water, alcohol such as ethanol, polyol (e.g. glycerol, propylene glycol, and liquid polyethylene glycol), or any suitable mixtures. The proper fluidity may be maintained, for example, by the use of a coating such as lecithin, by the maintenance of the required particle size in the case of dispersion and by use of surfactants according to formulation chemistry well known in the art. In certain embodiments, isotonic agents, e.g. sugars, polyalcohols such as mannitol, sorbitol, or sodium chloride may be desirable in the composition. Prolonged absorption of injectable compositions may be brought about by including in the composition an agent that delays absorption for example, monostearate salts and gelatin.

Solutions or suspensions used for intradermal or subcutaneous application typically include one or more of: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates; and tonicity adjusting agents such as, e.g., sodium chloride or dextrose. The pH can be adjusted with acids or bases, such as hydrochloric acid or sodium hydroxide, or buffers with citrate, phosphate, acetate and the like. Such preparations may be enclosed in ampoules, disposable syringes or multiple dose vials made of glass or plastic.

Sterile injectable solutions may be prepared by incorporating a multivalent CD20-binding molecule of the present invention in the required amount in an appropriate solvent with one or a combination of ingredients described above, as required, followed by sterilization microfiltration. Dispersions may be prepared by incorporating the active compound into a sterile vehicle that contains a dispersion medium and other ingredients, such as those described above. In the case of sterile powders for the preparation of sterile injectable solutions, the methods of preparation are vacuum drying and freeze-drying (lyophilization) that yield a powder of the active ingredient in addition to any additional desired ingredient from a sterile-filtered solution thereof.

When a therapeutically effective amount of a multivalent CD20-binding molecule of the present invention is designed to be administered by, e.g. intravenous, cutaneous or subcutaneous injection, the binding agent will be in the form of a pyrogen-free, parenterally acceptable aqueous solution. Methods for preparing parenterally acceptable protein solutions, taking into consideration appropriate pH, isotonicity, stability, and the like, are within the skill in the art. A preferred pharmaceutical composition for intravenous, cutaneous, or subcutaneous injection will contain, in addition to binding agents, an isotonic vehicle such as sodium chloride injection, Ringer's injection, dextrose injection, dextrose and sodium chloride injection, lactated Ringer's injection, or other vehicle as known in the art. A pharmaceutical composition of the present invention may also contain stabilizers, preservatives, buffers, antioxidants, or other additives well known to those of skill in the art.

As described elsewhere herein, a multivalent CD20-binding molecule of the present invention or composition thereof (e.g. pharmaceutical or diagnostic composition) may be prepared with carriers that will protect the multivalent CD20-binding molecule of the invention against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art (see e.g. *Sustained and Controlled Release Drug Delivery Systems* (Robinson J, ed., Marcel Dekker. Inc., NY, U.S., 1978).

In certain embodiments, the composition of the present invention (e.g. pharmaceutical or diagnostic compositions) may be formulated to ensure a desired distribution in vivo.

For example, the blood-brain barrier excludes many large and/or hydrophilic compounds. To target a therapeutic molecule or composition of the present invention to a particular in vivo location, it can be formulated, for example, in liposomes which may comprise one or more moieties that are selectively transported into specific cells or organs, thus enhancing targeted drug delivery. Exemplary targeting moieties include folate or biotin; mannosides; antibodies; surfactant protein A receptor; p120 catenin and the like.

Pharmaceutical compositions include parenteral formulations designed to be used as implants or particulate systems. Examples of implants are depot formulations composed of polymeric or hydrophobic components such as emulsions, ion exchange resins, and soluble salt solutions. Examples of particulate systems are microspheres, microparticles, nanocapsules, nanospheres, and nanoparticles. Controlled release formulations may be prepared using polymers sensitive to ions, such as, e.g. liposomes, polaxamer 407, and hydroxyapatite.

Pharmaceutical compositions of the present invention may be produced using techniques known in the art such that the produced compositions comprise emulsions, liposomes, niosomes, polymeric nanoparticles, and/or solid lipid nanoparticles (SLNs) (see e.g. Lakshmi P et al., *Venereal Leprol* 73: 157-161 (2007); *A Revolution in Dosage Form Design and Development. Recent Advances in Novel Drug Carrier Systems* (Sezer A, ed., InTech, 2012)).

VIII. Polynucleotides, Expression Vectors, and Host Cells of the Invention

Beyond the multivalent CD20-binding molecules of the present invention and compositions thereof, the polynucleotides that encode such multivalent CD20-binding molecules, the proteinaceous components of such multivalent CD20-binding molecules, or functional portions thereof, are also encompassed within the scope of the present invention. The term "polynucleotide" is equivalent to the term "nucleic acids," each of which includes one or more of: polymers of deoxyribonucleic acids (DNAs), polymers of ribonucleic acids (RNAs), analogs of these DNAs or RNAs generated using nucleotide analogs, and derivatives, fragments and homologs thereof. The polynucleotide of the invention may be single-, double-, or triple-stranded. Such polynucleotides are specifically disclosed to include all polynucleotides capable of encoding an exemplary protein, for example, taking into account the wobble known to be tolerated in the third position of RNA codons, yet encoding for the same amino acid as a different RNA codon (see Stothard P, *Biotechniques* 28: 1102-4 (2000)).

In one aspect, the invention provides polynucleotides which encode a multivalent CD20-binding molecule of the present invention (e.g. a multivalent CD20-binding protein of the present invention), or a component, fragment or derivative thereof. The polynucleotides may include, e.g., a nucleic acid sequence encoding a polypeptide at least 50%, 55%, 60%, 65%, 70%, 75%, 80%, 85%, 90%, 95%, 99% or more, identical to a polypeptide comprising one of the amino acid sequences of all or part of a multivalent CD20-binding molecule of the present invention. The invention also includes polynucleotides comprising nucleotide sequences that hybridize under stringent conditions to a polynucleotide which encodes all or part of a multivalent CD20-binding molecule of the present invention, or a fragment or derivative thereof, or the antisense or complement of any such sequence.

Derivatives or analogs of the polynucleotides (or multivalent CD20-binding proteins) of the invention include, inter alia, polynucleotide (or polypeptide) molecules having regions that are substantially homologous to the polynucleotides or multivalent CD20-binding proteins of the invention, e.g. by at least about 45%, 50%, 70%, 80%, 95%, 98%, or even 99% identity (with a preferred identity of 80-99%) over a polynucleotide or polypeptide sequence of the same size or when compared to an aligned sequence in which the alignment is done by a computer homology program known in the art. An exemplary program is the GAP program (Wisconsin Sequence Analysis Package, Version 8 for UNIX, Genetics Computer Group, University Research Park, Madison, Wis., U.S.) using the default settings, which uses the algorithm of Smith T. Waterman M, *Adv Appl Math* 2: 482-9 (1981). Also included are polynucleotides capable of hybridizing to the complement of a sequence encoding the multivalent CD20-binding proteins of the invention under stringent conditions (see e.g. Ausubel F et al., *Current Protocols in Molecular Biology* (John Wiley & Sons, New York, N.Y., U.S., 1993)), and below. Stringent conditions are known to those skilled in the art and may be found, e.g., in *Current Protocols in Molecular Biology* (John Wiley & Sons, NY, U.S., Ch. Sec. 6.3.1-6.3.6 (1989)).

The present invention further provides expression vectors that comprise the polynucleotides within the scope of the present invention. The polynucleotides capable of encoding the multivalent CD20-binding proteins of the invention may be inserted into known vectors, including bacterial plasmids, viral vectors and phage vectors, using material and methods well known in the art to produce expression vectors. Such expression vectors will include the polynucleotides necessary to support production of contemplated multivalent CD20-binding proteins of the invention within any host cell of choice or cell-free expression systems (e.g., pTxb 1 and pIVEX2.3). The specific polynucleotides comprising expression vectors for use with specific types of host cells or cell-free expression systems are well known to one of ordinary skill in the art, can be determined using routine experimentation, or may be purchased.

The term "expression vector," as used herein, refers to a polynucleotide, linear or circular, comprising one or more expression units. The term "expression unit" denotes a polynucleotide segment encoding a polypeptide of interest and capable of providing expression of the nucleic acid segment in a host cell. An expression unit typically comprises a transcription promoter, an open reading frame encoding the polypeptide of interest, and a transcription terminator, all in operable configuration. An expression vector contains one or more expression units. Thus, in the context of the present invention, an expression vector encoding a protein comprising a single polypeptide chain (e.g. a scFv genetically recombined with a Shiga toxin effector region) includes at least an expression unit for the single polypeptide chain, whereas a protein comprising, e.g. two or more polypeptide chains (e.g. one chain comprising a $V_L$ domain and a second chain comprising a $V_H$ domain linked to a toxin effector region) includes at least two expression units, one for each of the two polypeptide chains of the protein. For expression of multi-chain proteins of the invention, an expression unit for each polypeptide chain may also be separately contained on different expression vectors (e.g. expression may be achieved with a single host cell into which expression vectors for each polypeptide chain has been introduced).

Expression vectors capable of directing transient or stable expression of polypeptides and proteins are well known in the art. The expression vectors generally include, but are not limited to, one or more of the following: a heterologous signal sequence or peptide, an origin of replication, one or more marker genes, an enhancer element, a promoter, and a transcription termination sequence, each of which is well known in the art. Optional regulatory control sequences, integration sequences, and useful markers that can be employed are known in the art.

The term "host cell" refers to a cell which can support the replication or expression of the expression vector. Host cells may be prokaryotic cells, such as *E. coli* or eukaryotic cells (e.g. yeast, insect, amphibian, bird, or mammalian cells). Creation and isolation of host cell lines comprising a polynucleotide of the invention or capable of producing a multivalent CD20-binding protein of the invention may be accomplished using standard techniques known in the art.

Molecules and compositions within the scope of the present invention may comprise variants or derivatives of the multivalent CD20-binding molecules described herein that are produced by modifying the polynucleotide encoding a proteinaceous component of a multivalent CD20-binding molecule of the invention and/or a multivalent CD20-binding protein of the invention by altering one or more amino acids or deleting or inserting one or more amino acids that may render it more suitable to achieve desired properties, such as more optimal expression by a host cell.

IX. Delivery Devices and Kits

In certain embodiments, the invention relates to a device comprising one or more compositions of matter of the present invention, such as, e.g., a pharmaceutical composition, for delivery to a subject in need thereof. Thus, a delivery device comprising one or more proteinaceous compositions of the present invention (e.g. a multivalent CD20-binding molecule of the present invention) may be used to administer to a patient a composition of matter of the invention by various delivery methods, including: intravenous, subcutaneous, intramuscular or intraperitoneal injection; oral administration; transdermal administration; pulmonary or transmucosal administration; administration by implant, osmotic pump, cartridge or micro pump; or by other means recognized by a person of skill in the art.

Also within the scope of the present invention are kits comprising at least one composition of matter of the invention, and optionally, packaging and instructions for use. Kits may be useful for drug administration and/or diagnostic information gathering. A kit of the invention may optionally comprise at least one additional reagent (e.g. standards, markers and the like). Kits typically include a label indicating the intended use of the contents of the kit. The kit may further comprise reagents and other tools for detecting a cell type (e.g. a tumor cell) in a sample or in a subject, or for diagnosing whether a patient belongs to a group that responds to a therapeutic strategy which makes use of a multivalent CD20-binding molecule, composition, or related method of the present invention as described herein.

X. Exemplary Methods for Using Compositions of Matter of the Present Invention

Generally, it is an object of the invention to provide pharmacologically active agents, as well as compositions comprising the same, that can be used in the prevention and/or treatment of diseases, disorders, and conditions, such as certain cancers, tumors, growth abnormalities, immune disorders, or further pathological conditions mentioned herein. Accordingly, the present invention provides methods of using the multivalent CD20-binding molecules of the present, and compositions thereof, such as pharmaceutical compositions of the invention, for the targeted killing of CD20 expressing cells, for delivering additional exogenous materials into certain CD20 expressing cells, for labeling of the interiors of certain CD20 expressing cells, for collecting diagnostic information, and for treating various diseases, disorders, and conditions as described herein.

In particular, it is an object of the invention to provide such pharmacologically active agents, compositions, and/or methods that have certain advantages compared to the agents, compositions, and/or methods that are currently known in the art. Accordingly, the present invention provides methods of using multivalent CD20-binding molecules of the present invention, and compositions thereof, characterized by specified proteinaceous components. For example, any of the molecules shown in SEQ ID NOs: 1-304 may be specifically utilized as a component of the multivalent CD20-binding molecule or composition used in the following methods.

The present invention provides methods of killing a cell comprising the step of contacting the cell, either in vitro or in vivo, with a multivalent CD20-binding molecule, and/or composition thereof. The multivalent CD20-binding molecule of the present invention, and compositions thereof, can be used to kill a specific cell type upon contacting a cell or cells with one of the claimed compositions of matter. In certain embodiments, a multivalent CD20-binding molecule of the present invention and/or a composition thereof can be used to kill specific CD20+ cell types in a mixture of different cell types, such as mixtures comprising CD20+ cancer, tumor, hematologic, immune, and/or infected cells.

The present invention provides methods of killing cell(s), the method comprising the step of contacting a cell(s), with a multivalent CD20-binding molecule of the present invention, a multivalent CD20-binding molecule composition of the present invention, and/or a pharmaceutical composition of the present invention; wherein the cell(s) is physically coupled with a CD20 having the extracellular part bound by the two or more binding regions of the multivalent CD20-binding molecule or a multivalent CD20-binding molecule of a composition of the present invention. For certain embodiments, the step of contacting the cell(s) occurs in vitro. For certain other embodiments, the step of contacting the cell(s) occurs in vivo. For certain further embodiments, the cell(s) express at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, the cell(s) is CD20 positive cells. For certain embodiments, the cell(s) is physically coupled with a significant amount of extracellular CD20 which (1) have the extracellular part bound by the two or more CD20 binding regions of the multivalent CD20-binding molecule. For certain embodiments, the cell(s) are descendants or members of a B-cell lineage. For certain embodiments, the cell(s) is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

The multivalent CD20-binding molecule of the present invention, and compositions thereof, have varied applications, including, e.g., uses in depleting unwanted CD20+ cell types from tissues either in vitro or in vivo, uses in modulating immune responses to treat graft-versus-host disease, and uses in purging transplantation tissues of unwanted CD20+ cell types. In certain embodiments, a multivalent CD20-binding molecule of the present invention and/or a composition thereof can be used to kill CD20+ cancer cells in a mixture of different cell types. In certain embodiments, a multivalent CD20-binding molecule of the present invention and/or a composition thereof can be used to kill specific CD20+ cell types in a mixture of different cell types, such as cells in pre-transplantation tissues. In certain embodiments, a multivalent CD20-binding molecule of the present invention and/or a composition thereof can be used to kill specific CD20+ cell types in a mixture of cell types, such as cells in pre-administration tissue material for therapeutic purposes.

In certain embodiments, a multivalent CD20-binding molecule of the present invention and/or a composition thereof, alone or in combination with other compounds or pharmaceutical compositions, can show potent cell-kill activity when administered to a population of cells in vitro or in vivo in a subject, such as, e.g., in a patient in need of treatment. By targeting the delivery of enzymatically active Shiga toxin regions using high-affinity binding regions to CD20, this potent cell-kill activity can be restricted to specifically and selectively kill certain cell types within an organism, such as certain CD20 positive cancer cells, neoplastic cells, malignant tumor cells, non-malignant tumor cells, and/or immune cells.

In humans, CD20 is expressed by normal, B-cell lineage cells within certain cell developmental stages as well as numerous mature B-cell neoplasms, such as in NHL and CLL. In addition, CD20 is expressed by mature T-cell and NK-cell neoplasms. CD20 is expressed by a subset of normal T-cells as well as malignant T-cells such as in T-cell lymphomas (TCLs), including mycosis fungoides (MF), natural killer cell lymphoma (NK-cell lymphoma), peripheral T-cell lymphomas (PTCLs), and cutaneous T-cell lymphomas. CD20 is expressed by malignant T-cells in T-cell large granular lymphocyte leukemia (T-LGLL).

The present invention provides a method of killing a CD20+ cell in a patient in need thereof, the method comprising the step of administering to the patient at least one multivalent CD20-binding molecule of the present invention or a composition thereof, such as, e.g., a pharmaceutical composition comprising a multivalent CD20-binding molecule of the present invention.

In certain embodiments, the multivalent CD20-binding molecule of the present invention and/or a composition thereof is useful for killing malignant cells which express elevated levels of CD20 at a cellular surface. The multivalent CD20-binding molecule of the present invention and/or a composition thereof is particularly useful for killing neoplastic cells which express elevated levels of CD20 at a cellular surface.

Certain embodiments of the multivalent CD20-binding molecule of the present invention and/or a composition thereof can be used to kill a CD20-expressing cancer and/or tumor cell in a patient, such as, e.g. B-cell or T-cell cancers. The term "cancer cell" or "cancerous cell" refers to various neoplastic cells which grow and divide in an abnormally accelerated and/or unregulated fashion and will be clear to the skilled person. The term "tumor cell" includes both malignant and non-malignant cells (e.g. non-cancerous, benign tumor cells and non-cancerous "cancer" stem cells, tumor stem cells, pre-malignant cancer-initiating cells, tumor-initiating cells, or tumorigenic cells-all of which can give rise to daughter cells which become malignant tumor and/or cancer cells but are unable to metastasize on their own (see e.g. Martinez-Climent J et al., *Haematologica* 95: 293-302 (2010)). Generally, cancers and/or tumors can be defined as diseases, disorders, or conditions that are amenable to treatment and/or prevention. Neoplastic cells are often associated with one or more of the following: unregulated growth, lack of differentiation, local tissue invasion, angiogenesis, and metastasis. The cancers and tumors (either malignant or non-malignant) which are comprised of cancer cells and/or tumor cells which may benefit from methods and compositions of the invention will be clear to the skilled person. The present invention may be used to kill cancer stem cells, tumor stem cells, pre-malignant cancer-initiating cells, and tumor-initiating cells which commonly are slow dividing and resistant to cancer therapies like chemotherapy and radiation. For example, the following non-limiting examples of conditions involving cells with limited malignant potential may be diagnosed and/or treated using multivalent CD20-binding molecules of the present invention: monoclonal B-cell lymphocytosis (MBL), localized follicular lymphoma (localized FL), gastric extranodal marginal zone (MALT) lymphomas, and intrafollicular neoplasia (Limpens J et al., *Oncogene* 6: 2271-6 (1991); Liu H et al., *Lancet* 357: 39-40 (2001); Richard P et al., *J Clin Pathol* 59; 995-6 (2006); Roulland S et al., *J Exp Med* 203: 2425-31 (2006); Marti G et al., *Br J Haematol* 139:701-8 (2007); Aqel N et al., *Histopathology* 52: 256-60 (2008); Rawstron A et al., *N Engl J Med* 359: 575-83 (2008)). Similarly, cancer initiating cells and/or cancer stem cells may be detected and/or treated using multivalent CD20-binding molecules of the invention, such as, e.g., acute myeloid leukemia (AML) stem cells, B-cell non-Hodgkin's lymphoma (B-cell NHL) initiating cells, chronic myeloid leukemia (CML) stem cells, Hodgkin's lymphoma (HL or HD) stem-like cells, and mantle cell lymphoma (MCL) initiating cells (see e.g. Hope K et al., *Nat Immunol* 5: 738-43 (2004); Wang J, Dick J, *Trends Cell Biol* 15: 494-501 (2005); Ishikawa F et al., *Nat Biotechnol* 25: 1315-21 (2007); Jones R et al., *Blood* 113: 5920-6 (2009); Chen Z et al., *Stem Cell Res* 5: 212-225 (2010); Chomel J et al., *Blood* 118: 3657-60 (2011); Druker B, *J Clin Invest* 121: 396-409 (2011); Gerber J et al., *Blood* 119: 3571-7 (2012)).

Certain embodiments of the multivalent CD20-binding molecule of the present invention and/or a composition thereof can be used to kill an immune cell (whether healthy or malignant) in a patient by targeting an extracellular part of CD20 found physically coupled with the immune cell. Certain embodiments of the multivalent CD20-binding molecules of the invention, and compositions thereof, may be used to kill a healthy CD20+ immune cell(s) in a patient. CD20 is expressed by normal, B-cell lineage cells within certain cell developmental stages (van Meerten T et al., *Clin Cancer Res* 12: 4027-35 (2006)). CD20 is expressed by a subset of normal T-cells (Martin B et al., *J Cutan Pathol* 38: 663-9 (2011)).

It is within the scope of the present invention to utilize the multivalent CD20-binding molecule of the present invention and/or a composition thereof for the purposes of purging patient cell populations (e.g. bone marrow) of malignant, neoplastic, or otherwise unwanted B-cells and/or T-cells and then reinfusing the B-cell and/or T-cell depleted material into the patient.

It is within the scope of the present invention to utilize the multivalent CD20-binding molecule of the present invention and/or a composition thereof for the purposes of ex vivo depletion of B-cells and/or T-cells from isolated cell populations removed from a patient. In one non-limiting example, the multivalent CD20-binding molecule of the present invention and/or a composition thereof may be used in a method for prophylaxis of organ and/or tissue transplant rejection wherein the donor organ or tissue is perfused prior to transplant with a cytotoxic multivalent CD20-binding molecule of the present invention and/or a composition thereof in order to purge the organ of unwanted donor B-cells and/or T-cells.

It is also within the scope of the present invention to utilize the multivalent CD20-binding molecule of the present invention and/or a composition thereof for the purposes of depleting B-cells and/or T-cells from a donor cell population as a prophylaxis against graft-versus-host disease, and induction of tolerance, in a patient to undergo a bone marrow and or stem cell transplant.

It is within the scope of the present invention to provide a bone marrow recipient for prophylaxis or treatment of host-versus-graft disease via the targeted cell-killing of host B-cells and/or T-cells using multivalent CD20-binding molecule of the present invention and/or a composition thereof (see e.g. Sarantopoulos S et al., *Biol Blood Marrow Transplant* 21: 16-23 (2015)).

Additionally, the present invention provides a method of treating a disease, disorder, or condition in a patient comprising the step of administering to a patient in need thereof a therapeutically effective amount of at least one of the multivalent CD20-binding molecule of the present invention and/or composition thereof. Contemplated diseases, disorders, and conditions that can be treated using this method include cancers, malignant tumors, non-malignant tumors, growth abnormalities, and immune disorders. Administration of a "therapeutically effective dosage" of a composition of the invention may result in a decrease in severity of disease symptoms, an increase in frequency and duration of disease symptom-free periods, or a prevention of impairment or disability due to the disease affliction.

The therapeutically effective amount of a composition of the present invention will depend on the route of administration, the type of mammal being treated, and the physical characteristics of the specific patient under consideration. These factors and their relationship to determining this amount are well known to skilled practitioners in the medical arts. This amount and the method of administration can be tailored to achieve optimal efficacy, and may depend on such factors as weight, diet, concurrent medication and other factors, well known to those skilled in the medical arts. The dosage sizes and dosing regimen most appropriate for human use may be guided by the results obtained by the present invention, and may be confirmed in properly designed clinical trials. An effective dosage and treatment protocol may be determined by conventional means, starting with a low dose in laboratory animals and then increasing the dosage while monitoring the effects, and systematically varying the dosage regimen as well. Numerous factors may be taken into consideration by a clinician when determining an optimal dosage for a given subject. Such considerations are known to the skilled person.

An acceptable route of administration may refer to any administration pathway known in the art, including but not limited to aerosol, enteral, nasal, ophthalmic, oral, parenteral, rectal, vaginal, or transdermal (e.g. topical administration of a cream, gel or ointment, or by means of a transdermal patch). "Parenteral administration" is typically associated with injection at or in communication with the intended site of action, including infraorbital, infusion, intraarterial, intracapsular, intracardiac, intradermal, intramuscular, intraperitoneal, intrapulmonary, intraspinal, intrasternal, intrathecal, intrauterine, intravenous, subarachnoid, subcapsular, subcutaneous, transmucosal, or transtracheal administration.

For administration of a pharmaceutical composition of the invention, the dosage range will generally be from about 0.0001 to 100 milligrams per kilogram (mg/kg), and more, usually 0.01 to 5 mg/kg, of the subject's body weight. Exemplary dosages may be 0.25 mg/kg body weight, 1 mg/kg body weight, 3 mg/kg body weight, 5 mg/kg body weight or 10 mg/kg body weight or within the range of 1-10 mg/kg. An exemplary treatment regime is a once or twice daily administration, or a once or twice weekly administration, once every two weeks, once every three weeks, once every four weeks, once a month, once every two or three months or once every three to 6 months. Dosages may be selected and readjusted by the skilled health care professional as required to maximize therapeutic benefit for a particular patient.

A multivalent CD20-binding molecule of the present invention and/or a composition thereof will typically be administered to the same patient on multiple occasions. Intervals between single doses can be, for example, 1-4 days, weekly, monthly, every two or three months, every six months, or yearly. Intervals between administrations can also be irregular, based on regulating blood levels of the active compound or based on other markers, indications, or signs present in the subject or patient. Dosage regimens for a compound of the invention (e.g. a multivalent CD20-binding molecule composition of the present invention) include intravenous administration of 1 mg/kg body weight or 3 mg/kg body weight with the compound administered every two to four weeks for six doses, then every three months at 3 mg/kg body weight or 1 mg/kg body weight.

A multivalent CD20-binding molecule of the present invention and/or a composition thereof may be administered via one or more routes of administration, using one or more of a variety of methods known in the art. As will be appreciated by the skilled worker, the route and/or mode of administration will vary depending upon the desired results. Routes of administration for multivalent CD20-binding molecule compositions, pharmaceutical compositions, and diagnostic compositions of the present invention include, e.g. intravenous, intramuscular, intradermal, intraperitoneal, subcutaneous, spinal, or other parenteral routes of administration, for example by injection or infusion. In other embodiments, a multivalent CD20-binding molecule of the present invention and/or a composition thereof may be administered by a non-parenteral route, such as a topical, epidermal or mucosal route of administration, for example, intranasally, orally, vaginally, rectally, sublingually, or topically.

Therapeutic multivalent CD20-binding molecule of the present invention and/or a composition thereof may be administered with one or more of a variety of medical devices known in the art. For example, in one embodiment, a pharmaceutical composition of the invention may be administered with a needleless hypodermic injection device. Examples of well-known implants and modules useful in the present invention are in the art, including e.g., implantable micro-infusion pumps for controlled rate delivery; devices for administering through the skin; infusion pumps for delivery at a precise infusion rate; variable flow implantable infusion devices for continuous drug delivery; and osmotic drug delivery systems. These and other such implants, delivery systems, and modules are known to those skilled in the art.

A multivalent CD20-binding molecule of the present invention and/or a composition thereof may be administered alone or in combination with one or more other therapeutic or diagnostic agents. A combination therapy may include a multivalent CD20-binding molecule of the present invention and/or a pharmaceutical composition thereof combined with at least one other therapeutic agent selected based on the particular patient, disease or condition to be treated. Examples of other such agents include, inter alia, a cytotoxic, anti-cancer or chemotherapeutic agent, an anti-inflammatory or anti-proliferative agent, an antimicrobial or antiviral agent, growth factors, cytokines, an analgesic, a therapeutically active small molecule or polypeptide, a single chain antibody, a classical antibody or fragment thereof, or a nucleic acid molecule which modulates one or more signaling pathways, and similar modulating therapeutics which may complement or otherwise be beneficial in a therapeutic or prophylactic treatment regimen.

Treatment of a patient with a multivalent CD20-binding molecule of the present invention and/or a composition thereof preferably leads to cell death of targeted CD20+ cells and/or the inhibition of growth of targeted CD20+ cells. As such, certain multivalent CD20-binding molecules of the present invention, and pharmaceutical compositions comprising them, will be useful in methods for treating a variety of pathological disorders in which killing or depleting CD20+ target cells may be beneficial, such as, inter alia, cancers, tumors, immune disorders, and growth abnormalities involving CD20+ cells. The present invention provides methods for suppressing cell proliferation, and treating cell disorders, including neoplasia, overactive B-cells, and overactive T-cells.

CD20 is expressed by cells involved in a variety of malignancies, such as, e.g., hematologic diseases, rheumatic diseases, hematologic cancers, leukemias, lymphomas, melanomas, myelomas, B-cell lymphomas, B-cell non-Hodgkins lymphomas (B-cell NHL), Burkitt's lymphomas (BL), B-cell chronic lymphocytic leukemias (B-cell CLL), chronic lymphocytic leukemias (CLL), diffuse large B-cell lymphomas (DLBCL or DLBL), follicular lymphomas (FL), hairy cell leukemias (HCL), Hodgkins lymphomas (HD), immunoblastic large cell lymphomas, mantle cell lymphomas (MCL), melanomas, non-Hodgkins lymphomas (NHL), precursor B-lymphoblastic lymphomas (B-LBL), small lymphocytic lymphoma (SLL), and T-cell lymphomas (TCL), amyloidosis, ankylosing spondylitis, asthma, Crohn's disease, diabetes, graft rejection, graft-versus-host disease, Hashimoto's thyroiditis, hemolytic uremic syndrome. HIV-related diseases, lupus erythematosus, multiple sclerosis, polyarteritis nodosa, polyarthritis, psoriasis, psoriatic arthritis, rheumatoid arthritis, scleroderma, septic shock, Sjorgren's syndrome, ulcerative colitis, and/or vasculitis.

In certain embodiments, multivalent CD20-binding molecule of the present invention and/or a composition thereof can be used to treat or prevent cancers, tumors (malignant and non-malignant), growth abnormalities, and immune disorders. In a further aspect, the above ex vivo method can be combined with the above in vivo method to provide methods of treating or preventing rejection in bone marrow transplant recipients, and for achieving immunological tolerance.

In certain embodiments, the present invention provides methods for treating malignancies or neoplasms and other blood cell associated cancers in a mammalian subject, such as a human, the method comprising the step of administering to a subject in need thereof a therapeutically effective amount of a multivalent CD20-binding molecule of the present invention and/or a composition thereof.

The multivalent CD20-binding molecule of the present invention and/or a composition thereof have varied applications, including, e.g., uses in removing unwanted B-cells and/or T-cells, uses in modulating immune responses to treat graft-versus-host disease, uses as antiviral agents, uses as antimicrobial agents, and uses in purging transplantation tissues of unwanted cell types. The multivalent CD20-binding molecule of the present invention and/or a composition thereof are commonly anti-neoplastic agents—meaning they are capable of treating and/or preventing the development, maturation, or spread of neoplastic or malignant cells by inhibiting the growth and/or causing the death of CD20+ cancer, neoplastic, or tumor cells.

In certain embodiments, a multivalent CD20-binding molecule of the present invention and/or a composition thereof is used to treat a B-cell-, plasma cell-, T-cell- or antibody-mediated disease or disorder, such as for example hematologic diseases, rheumatic diseases, hematologic cancers, leukemias, lymphomas, melanomas, myelomas, B-cell lymphomas, B-cell non-Hodgkins lymphomas (B-cell NHL), Burkitt's lymphomas (BL). B-cell chronic lymphocytic leukemias (B-cell CLL), chronic lymphocytic leukemias (CLL), diffuse large B-cell lymphomas (DLBCL or DLBL), follicular lymphomas (FL), hairy cell leukemias (HCL), Hodgkins lymphomas (HD), immunoblastic large cell lymphomas, mantle cell lymphomas (MCL), melanomas, non-Hodgkins lymphomas (NHL), precursor B-lymphoblastic lymphomas (B-LBL), small lymphocytic lymphoma (SLL), and T-cell lymphomas (TCL), amyloidosis, ankylosing spondylitis, asthma, Crohn's disease, diabetes, graft rejection, graft-versus-host disease, Hashimoto's thyroiditis, hemolytic uremic syndrome. HIV-related diseases, lupus erythematosus, multiple sclerosis, polyarteritis nodosa, polyarthritis, psoriasis, psoriatic arthritis, rheumatoid arthritis, scleroderma, septic shock, Sjorgren's syndrome, ulcerative colitis, and/or vasculitis.

It is within the scope of the present invention to provide a prophylaxis or treatment for diseases or conditions mediated by B-cells and/or T-cells by administering the multivalent CD20-binding molecule of the present invention and/or a composition thereof, to a patient for the purpose of killing B-cells and/or T-cells in the patient. This usage is compatible with preparing or conditioning a patient for bone marrow transplantation, stem cell transplantation, tissue transplantation, or organ transplantation, regardless of the source of the transplanted material, e.g., human or non-human sources.

It is within the scope of the present invention to provide a bone marrow recipient for prophylaxis or treatment of host-versus-graft disease via the targeted CD20+ cell-killing of host T-cells using a multivalent CD20-binding molecule of the present invention and/or a composition thereof.

The multivalent CD20-binding molecule of the present invention and/or a composition thereof may be utilized in a method of treating cancer comprising administering to a patient, in need thereof, a therapeutically effective amount of the protein composition or a pharmaceutical composition of the present invention. For certain embodiments of the methods of the present invention, the condition, disease, or disorder being treated is related to hematologic diseases, rheumatic diseases, hematologic cancers, leukemias, lymphomas, melanomas, myelomas, B-cell lymphomas, B-cell non-Hodgkins lymphomas (B-cell NHL), Burkitt's lymphomas (BL), B-cell chronic lymphocytic leukemias (B-cell CLL), chronic lymphocytic leukemias (CLL), diffuse large B-cell lymphomas (DLBCL or DLBL), follicular lymphomas (FL), hairy cell leukemias (HCL), Hodgkins lymphomas (HD), immunoblastic large cell lymphomas, mantle cell lymphomas (MCL), melanomas, non-Hodgkins lymphomas (NHL), precursor B-lymphoblastic lymphomas (B-LBL), small lymphocytic lymphoma (SLL), and T-cell lymphomas (TCL), amyloidosis, ankylosing spondylitis, asthma, Crohn's disease, diabetes, graft rejection, graft-versus-host disease, Hashimoto's thyroiditis, hemolytic uremic syndrome, HIV-related diseases, lupus erythematosus, multiple sclerosis, polyarteritis nodosa, polyarthritis, psoriasis, psoriatic arthritis, rheumatoid arthritis, scleroderma, septic shock, Sjorgren's syndrome, ulcerative colitis, and/or vasculitis.

Non-limiting examples of subtypes of hematologic cancers (e.g. leukemias, lymphomas, and myelomas) that may be treated with the multivalent CD20-binding molecules and compositions of the present invention include acute myeloid leukemias (acute myelogenous leukemia or AML), acute non-lymphocytic leukemias, B-cell lymphomas, B-cell non-Hodgkin's lymphomas (B-cell NHL), B-cell acute lymphoblastic leukemias (B-ALL or BCP-ALL), B-cell prolymphocytic leukemias (B-PLL). B-lymphoblastic lymphomas (B-LBL), Burkitt's lymphomas (BL), atypical Burkitt's lymphomas (atypical BL), chronic lymphocytic leukemias (CLL), chronic myeloid leukemias (CML), cutaneous B-cell lymphomas (CBCL), diffuse large B-cell lymphomas (DLBCL or DLBL), follicular lymphomas (FL), hairy cell leukemias (HCL), heavy chain diseases, Hodgkin's lymphomas (HL or HD), immunoblastic large cell lymphomas, lymphomatoid granulomatosis (LG or LYG), lymphoplasmacytic lymphomas, mantle cell lymphomas (MCL), marginal zone lymphomas (MZL), multiple myelomas (MM), nodular lymphocyte predominant Hodgkin's lymphomas (NLPHL), non-Hodgkin's lymphomas (NHL), plasmablastic lymphomas (PBL), plasmablastic lymphomas associated with multicentric Castleman disease, plasma cell neoplasmas, plasma cell myelomas, primary effusion lymphomas (PEL), small lymphocvtic lymphomas (SLL), T-cell large granular lymphocyte leukemias (T-LGLL), T-cell lymphomas (TCL), peripheral T-cell lymphomas (PTCL), T-cell prolymphocytic leukemias (T-PLL), mycosis fungiodes (MF), and Waldenström's macroglobulinemias (WM).

The multivalent CD20-binding molecule of the present invention and/or a composition thereof may be utilized in a method of treating an immune disorder comprising administering to a patient, in need thereof, a therapeutically effective amount of the multivalent CD20-binding molecule of the present invention and/or a composition thereof. For certain embodiments of the methods of the present invention, the immune disorder is related to an inflammation associated with a disease selected from the group consisting of: amyloidosis, ankylosing spondylitis, asthma, Crohn's disease, diabetes, graft rejection, graft-versus-host disease, Graves' disease, Graves' ophthalmopathy, Hashimoto's thyroiditis, heavy chain disease, hemolytic uremic syndrome. HIV-related diseases, lupus erythematosus, multiple sclerosis, neuromyelitis optica spectrum disorders, N-methyl D-aspartate (NMDA) receptor encephalitis, opsoclonus myoclonus syndrome (OMS), paroxysmal nocturnal hemoglobinuria, polyarteritis nodosa, polyarthritis, psoriasis, psoriatic arthritis, rheumatoid arthritis, scleritis, scleroderma, septic shock, Sjorgren's syndrome, ulcerative colitis, and vasculitis.

Among certain embodiments of the present invention is using the multivalent CD20-binding molecule of the present invention and/or a composition thereof as a component of a pharmaceutical composition or medicament for the treatment or prevention of a cancer, tumor, immune disorder, and/or growth abnormality involving a CD20+ cell. For example, immune disorders presenting on the skin of a patient may be treated with such a medicament in efforts to reduce inflammation. In another example, skin tumors may be treated with such a medicament in efforts to reduce tumor size or eliminate the tumor completely.

For certain cancers, depletion and/or inhibition of B-cells generally may improve disease outcomes, such as, e.g. by depleting cancer escape promoting regulatory B-cells (see e.g. Olkhanud P et al., *Cancer Res* 69: 5996-6004 (2009); Olkhanud P et al., *Cancer Res* 71: 3505-15 (2011)).

Among certain embodiments of the present invention are methods of inducing cellular internalization of a multivalent CD20-binding molecule into a cell(s) and/or internalizing a cell surface localized CD20 bound by a multivalent CD20-binding molecule of the present invention, the method comprising the step of contacting the cell(s) with a multivalent CD20-binding molecule of the present invention, a multivalent CD20-binding molecule composition of the present invention, a pharmaceutical composition of the present invention, and/or a diagnostic composition of the present invention. For certain embodiments of this inducing internalization method, the cell(s) is physically coupled with CD20, which have the extracellular part bound by two or more CD20 binding regions of the multivalent CD20-binding molecule. For certain further embodiments of the inducing cellular internalization method, the step of contacting the cell(s) occurs in vitro. For certain other embodiments, the step of contacting the cell(s) occurs in vivo, such as, e.g., within a patient. For certain further embodiments of the inducing cellular internalization method, the cellular internalization of the multivalent CD20-binding molecule occurs in about five hours, four hours, three hours, two hours, one hour, thirty minutes, or less at a physiological temperature appropriate for the cell and/or at about 37 degrees Celsius. For certain further embodiments, the cell expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, the cell is a CD20 positive cell. For certain embodiments, the cell is physically coupled with a significant amount of extracellular CD20 which (1) have the extracellular part bound by the two or more CD20 binding regions of the multivalent CD20-binding molecule. For certain embodiments, the cell is a descendant or member of a B-cell lineage. For certain embodiments, the cell is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For certain embodiments, the methods of the present invention provide a method of inducing cellular internalization of a cell surface localized CD20 bound by a multivalent CD20-binding molecule in a patient, the method comprising the step of administering to the patient a multivalent CD20-binding molecule of the present invention, a multivalent CD20-binding molecule composition of the present invention, pharmaceutical composition of the present invention, and/or a diagnostic composition of the present invention.

Additionally, the present invention provides methods for delivering an exogenous material to the inside of a cell, the method comprising the step of contacting the cell(s), either in vitro or in vivo, with a multivalent CD20-binding molecule of the present invention which comprises an additional exogenous material, a multivalent CD20-binding molecule composition of the present invention comprising a multivalent CD20-binding molecule of the present invention which comprises an additional exogenous material, a pharmaceutical composition of the present invention comprising a multivalent CD20-binding molecule of the present invention which comprises an additional exogenous material, and/or a diagnostic composition of the present invention comprising a multivalent CD20-binding molecule of the present invention which comprises an additional exogenous material. For certain further embodiments, the cell is physically coupled with CD20 which have the extracellular part bound by two or more CD20 binding regions of the multivalent CD20-binding molecule. For certain further embodiments, the cell expresses at a cellular surface the CD20 which (1) have the extracellular part bound by the two or more CD20 binding regions of the multivalent CD20-binding molecule, (2) have a transmembrane domain, and (3) remain physically coupled to the cell. For certain further embodiments, the cell is a CD20 positive cell. For certain embodiments, the cell is physically coupled with a significant amount of extracellular CD20 which (1) have the extracellular part bound by the two or more CD20 binding regions of the multivalent CD20-binding molecule. For certain embodiments, the cell is a descendant or member of a B-cell lineage. For certain embodiments, the cell is selected from the group consisting of: malignant B-cell, B-cell leukemia cell, B-cell lymphoma cell, B-cell myeloma cell, acute myeloid leukemia cell, acute non-lymphocytic leukemia cell, B-cell chronic lymphocytic leukemia cell, B-cell lymphoma cell, B-cell non-Hodgkin's lymphoma cell, B-cell precursor acute lymphoblastic leukemia cell, B-cell prolymphocytic leukemia cell, Burkitt's lymphoma cell, chronic lymphocytic leukemia cell, chronic myeloid leukemia cell, diffuse large B-cell lymphoma cell, follicular lymphoma cell, hairy cell leukemia cell, Hodgkin's lymphoma cell, immunoblastic large cell lymphoma cell, mantle cell lymphoma cell, melanoma cell, multiple myeloma cell, neoplastic plasma cell, nodular lymphocyte predominant Hodgkin's lymphoma cell, non-Hodgkin's lymphoma cell, plasmablastic lymphoma cell, plasma cell myeloma cell, precursor B-lymphoblastic lymphoma cell, small lymphocytic lymphoma cell, malignant T-cell, T-cell leukemia cell, T-cell lymphoma cell, T-cell large granular lymphocyte leukemia cell, T-cell prolymphocytic leukemia, healthy B-cell lineage cell, and/or healthy T-cell.

For certain embodiments, the present invention provides a method of delivering an exogenous material (e.g., a detection promoting agent for collecting diagnostic information) to the inside of a cell in a patient, the method comprising the step of administering to the patient a multivalent CD20-binding molecule of the present invention which comprises an additional exogenous material, a multivalent CD20-binding molecule composition of the present invention comprising a multivalent CD20-binding molecule of the present invention which comprises an additional exogenous material, a pharmaceutical composition of the present invention comprising a multivalent CD20-binding molecule of the present invention which comprises an additional exogenous material, and/or a diagnostic composition of the present invention comprising a multivalent CD20-binding molecule of the present invention which comprises an additional exogenous material.

Among certain embodiments of the present invention is a method of using a multivalent CD20-binding molecule of the present invention and/or a composition thereof (e.g. a diagnostic composition of the present invention) to detect the presence of a cell (e.g., a CD20-expressing cell, a CD20 positive cell, a CD20+ cell type, and/or a cell physically coupled with a significant amount of cell-surface CD20) for the purpose of information gathering regarding diseases, conditions and/or disorders characterized by CD20 cell-surface expression, characterized by changes in the amount of cell surface accessible CD20, and/or associated with changes in CD20 cell-surface expression. The method comprises contacting a cell with a diagnostically sufficient amount of a multivalent CD20-binding molecule of the present invention and/or a composition thereof to detect the multivalent CD20-binding molecule by an assay or diagnostic technique.

The term "diagnostically sufficient amount" refers to an amount that provides adequate detection and accurate measurement for information gathering purposes by the particular assay or diagnostic technique utilized. Generally, the diagnostically sufficient amount for a whole organism in vivo diagnostic use will be a non-cumulative dose between 0.1 mg to 100 mg of the detection promoting agent linked-multivalent CD20-binding molecule per kg of subject per subject. Typically, the amount of multivalent CD20-binding molecule used in these information gathering methods will be as low as possible provided that it is still a diagnostically sufficient amount. For example, for in vivo detection in an organism, the amount of multivalent CD20-binding molecule administered to a subject will be as low as possible.

The cell type-specific targeting of multivalent CD20-binding molecule of the present invention combined with detection promoting agents provides a way to detect and image cells physically coupled with an extracellular CD20 target biomolecule. Imaging of CD20+ cells using the multivalent CD20-binding molecule of the present invention and/or a composition thereof may be performed in vitro or in vive by any suitable technique known in the art. Diagnostic information may be collected using various methods known in the art, including whole body imaging of an organism or using ex vivo samples taken from an organism. The term "sample" used herein refers to any number of things, but not limited to, fluids such as blood, urine, serum, lymph, saliva, anal secretions, vaginal secretions, and semen, and tissues obtained by biopsy procedures. For example, various detection promoting agents may be utilized for non-invasive in vivo tumor imaging by techniques such as magnetic resonance imaging (MRI), optical methods (such as direct, fluorescent, and bioluminescent imaging), positron emission tomography (PET), single-photon emission computed tomography (SPECT), ultrasound, x-ray computed tomography, and combinations of the aforementioned.

Among certain embodiments of the present invention is a method of using a multivalent CD20-binding molecule of the present invention and/or a composition thereof (e.g. a pharmaceutical and/or diagnostic composition of the present invention) to label or detect the interiors of CD20+ neoplastic cells and/or immune cell types. Based on the ability of the multivalent CD20-binding molecule of the present invention to enter specific cell types and route within cells via retrograde intracellular transport, the interior compartments of specific cell types are labeled for detection. This can be performed in vive on cells in situ, at disease loci within a patient, or in vitro in an ex vivo setting on cells and tissues removed from an organism. e.g. biopsy material. The detection of CD20+ cells, cell types, and cell populations may be used in the diagnosis and imaging of tumors and immune cells that express elevated levels of CD20. Certain multivalent CD20-binding molecules of the present invention and/or compositions thereof may be employed to image or visualize a site of possible accumulation of CD20+ cells in a mammal. These methods may be used to identify sites of tumor development or residual tumor cells after a therapeutic intervention.

Diagnostic compositions of the present invention may be used to characterize a disease, disorder, or condition as potentially treatable by a related pharmaceutical composition of the invention. Certain compositions of matter of the invention may be used to determine whether a patient belongs to a group that responds to a therapeutic strategy which makes use of a multivalent CD20-binding molecule of the present invention, and/or a composition thereof, or related method of the invention as described herein or is well suited for using a delivery device of the invention.

Diagnostic compositions of the present invention may be used after a disease, e.g. cancer, is detected in order to better characterize it, such as to monitor distant metastases, heterogeneity, and stage of cancer progression. The phenotypic assessment of disease disorder or infection can help prognosis and prediction during therapeutic decision making. In disease reoccurrence, certain methods of the invention may be used to discriminate local versus systemic problems.

Diagnostic compositions of the present invention may be used to assess responses to therapeutic(s) regardless of the type of therapeutic, e.g. small molecule drug or biological drug, or cell-based therapy. For example, certain embodiments of the diagnostic compositions of the present invention may be used to measure changes in tumor size, changes in CD20+ cell populations including number and distribution, or monitoring a different marker than the antigen targeted by a therapy already being administered to a patient.

Certain embodiments of the method detecting the presence of a CD20+ cell type may be used to gather information regarding diseases, disorders, and conditions, such as, for example cells related to malignant cells, tumor cells, cancer cells, and/or immune cells related to hematologic diseases, rheumatic diseases, hematologic cancers, leukemias, lymphomas, melanomas, myelomas, B-cell lymphomas, B-cell non-Hodgkins lymphomas (B-cell NHL), Burkitt's lymphomas (BL), B-cell chronic lymphocytic leukemias (B-cell CLL), chronic lymphocytic leukemias (CLL), diffuse large B-cell lymphomas (DLBCL or DLBL), follicular lymphomas (FL), hairy cell leukemias (HCL), Hodgkins lymphomas (HD), immunoblastic large cell lymphomas, mantle cell lymphomas (MCL), melanomas, non-Hodgkins lymphomas (NHL), precursor B-lymphoblastic lymphomas (B-LBL), small lymphocytic lymphoma (SLL), and T-cell lymphomas (TCL), amyloidosis, ankylosing spondylitis, asthma, Crohn's disease, diabetes, graft rejection, graft-versus-host disease, Hashimoto's thyroiditis, hemolytic uremic syndrome, HIV-related diseases, lupus erythematosus, multiple sclerosis, polyarteritis nodosa, polyarthritis, psoriasis, psoriatic arthritis, rheumatoid arthritis, scleroderma, septic shock, Sjorgren's syndrome, ulcerative colitis, and/or vasculitis.

In certain embodiments, the multivalent CD20-binding molecule of the present invention and/or a composition thereof are used for both diagnosis and treatment, or for diagnosis alone.

The present invention is further illustrated by the following non-limiting examples of compositions comprising selectively cytotoxic multivalent CD20-binding molecules with Shiga toxin effector regions derived from A Subunits of members of the Shiga toxin family and two or more CD20 binding regions capable of binding extracellular parts of CD20 physically coupled to specific, CD20-expressing cell types.

EXAMPLES

The following Examples describe different multivalent CD20-binding molecules comprising Shiga toxin A Subunit effector polypeptide regions. Exemplary, multivalent. CD20-binding molecules of the present invention 1) bound to CD20 expressed at the surface of target cell types, such as, e.g., human lymphoma cells, 2) enter target cells, and effectively routed, catalytically active, Shiga toxin effector polypeptide to the cytosol of target cells resulting in the death of these CD20-expressing cells.

The exemplary, multivalent CD20-binding molecule compositions of the present invention, which were enriched with high-proportions of multivalent CD20-binding molecule(s) relative to monovalent CD20-binding molecule(s), showed greatly improved cytotoxic activity compared to a protein composition predominantly composed of a monovalent CD20-binding protein, which was a component of the exemplary, multivalent CD20-binding molecules of the present invention shown in Example 1. The improved cytotoxic effects of exemplary, multivalent CD20-binding molecule compositions of the present invention could not be accounted for by predicted increases in cytotoxicity resulting from increases in the CD20-binding valences of the multivalent CD20-binding molecule variants as compared to the monovalent CD20-binding molecule.

Throughout the Examples, the term "CD20-binding protein" is used to refer to a Shiga toxin A Subunit derived, immunotoxin comprising one or more recombinant fusion polypeptides, which each comprise 1) one or more immunoglobulin-type CD20 binding regions capable of binding an extracellular part of a CD20 with high affinity, and 2) one or more Shiga toxin effector polypeptide regions. Certain multivalent CD20-binding proteins of the present invention shown in the Examples below were multimeric, such as, e.g., a homodimer consisting essentially of two, identical, monovalent CD20-binding proteins which were linked together.

Example 1. Exemplary, Multivalent CD20-Binding Proteins of the Present Invention and Enriched Compositions Thereof Exemplary, multivalent CD20-binding molecules of the present invention were created by linking multiple, CD20- binding, single-chain, variable fragment (scFv) polypeptides with multiple, Shiga toxin A Subunit effector polypeptides using reagents and techniques known to the skilled worker. In this Example, the exemplary, multivalent CD20-binding molecules of the present invention were multivalent CD20-binding proteins which each comprised 1) two or more single-chain, variable fragment (scFv), binding regions capable of binding an extracellular CD20 with high affinity linked with 2) two or more Shiga toxin A Subunit derived toxin effector regions.

Multivalent CD20-binding proteins were designed, produced, and purified using techniques known to the skilled worker to create protein compositions where the predominant protein(s) in the composition were multivalent CD20-binding proteins of the present invention. For example, the exemplary compositions $(\alpha CD20\text{-}scFv::SLT\text{-}1A)_2$ and $(\alpha CD20\text{-}scFv::SLT\text{-}1A)_{2+n}$ were predominantly composed of proteins that were multivalent CD20-binding proteins of the present invention. As shown below, exemplary, multivalent CD20-binding protein compositions of the present invention were capable, via the activity of their multivalent CD20-binding protein constituent(s), of selectively killing cells that express CD20 on their surface by internalizing, routing a toxin effector region to the cytosol, and inactivating ribosomes.

However, the protein composition $\alpha CD20\text{-}scFv::SLT\text{-}1A$, which was predominantly composed of monovalent CD20-binding protein representing a component of the multivalent CD20-binding proteins of this Example, did not exhibit potent, CD20-targeted cytotoxicity over a wide-range of protein concentrations. The monovalent CD20-binding protein composition $\alpha CD20\text{-}scFv::SLT\text{-}1A$ was unexpectedly found to be inactive at concentrations with similar total molecule binding levels to CD20-expressing cells as concentrations of exemplary, multivalent CD20-binding protein compositions of the present invention at which these exemplary multivalent CD20-binding protein compositions exhibited potent targeted-cytotoxicity to CD20-expressing cells. This was surprising because the monovalent CD20-binding protein 1) had the same CD20 binding region and Shiga toxin effector region as the exemplary, multivalent CD20-binding proteins and 2) exhibited a similar catalytic activity in vitro as the exemplary, multivalent CD20-binding proteins.

A. Construction, Production, and Purification of Cytotoxic, Multivalent, CD20-Binding Proteins to Produce the Composition $(\alpha CD20\text{-}scFv::SLT\text{-}1A)_n$ In this Example, the Shiga toxin effector region was derived from the A Subunit of Shiga-like toxin 1 (SLT-1A). A polynucleotide was obtained that encoded amino acids 1-251 of SLT-1A (Cheung M et al., *Mol Cancer* 9: 28 (2010)). Immunoglobulin-type binding regions comprising single-chain variable fragments (scFv) αCD20-scFv were derived from a monoclonal antibody, developed to bind human CD20, such that a single-chain variable fragment was created with the two immunoglobulin variable regions ($V_L$ and $V_H$) separated by a linker known in the art. The immunoglobulin-type binding region and the Shiga toxin effector region were cloned in frame to form a genetically fused protein.

A polynucleotide encoding the Shiga toxin effector region comprising the polypeptide shown in SEQ ID NO:4 (corresponding to amino acids 1-251 of SEQ ID NO: 1) was cloned in frame with a polynucleotide encoding an immunoglobulin-type binding region αCD20-scFv. In certain experiments, the full-length coding sequence of the subunit of the multivalent cytotoxic proteins of this Example included a polynucleotide encoding a myc tag or Strep-Tag® II to facilitate detection and/or purification. A polynucleotide encoding an αCD20-scFv::SLT-1A fusion protein subunit (SEQ ID NO:54) of the multivalent CD20-binding protein(s) of the exemplary protein composition "$(\alpha CD20\text{-}scFv::SLT\text{-}1A)_n$" were synthesized using services from DNA 2.0, Inc. (Menlo Park, Calif., U.S.) or cloned using standard techniques.

CD20-binding proteins comprising the constituents of the protein composition $(\alpha CD20\text{-}scFv::SLT\text{-}1A)_n$ were produced by protein expression from the polynucleotide template encoding the protein αCD20-scFv::SLT-1A (SEQ ID NO:54) using a bacterial system or cell-free expression system known in the art. Protein purification was accomplished using standard techniques known in the art, including capto-L and chitin affinity chromatography. For certain purifications, multivalent CD20-binding proteins were produced in bacteria and purified with the IMPACT™ (Intein Mediated Purification with an Affinity Chitin-binding Tag) system (New England Biolabs, Ipswich, Mass., U.S.). Chitin affinity purification was performed according to the manufacturer's instructions except in certain purifications, a protein L column chromatography step was performed and then the intein was cleaved. Then uncleaved material was removed using chromatography through a chitin resin in flow-through mode.

After purification, the $(\alpha CD20\text{-}scFv::SLT\text{-}1A)_n$ protein composition was oxidized using copper sulfate as a catalyst. Then, the oxidized $(\alpha CD20\text{-}scFv::SLT\text{-}1A)_n$ composition was purified into three different CD20-binding protein compositions using hydroxyapatite (hydroxylapatite) chromatography. Hydroxyapatite chromatography was used to separate different monomeric and multimeric forms of the CD20-binding proteins of the $(\alpha CD20\text{-}scFv::SLT\text{-}1A)_n$ composition into different chromatographic fractions and then certain fractions were pooled—one protein pool named "αCD20-scFv::SLT-1A composition" predominantly comprised the monovalent CD20-binding protein αCD20-scFv::SLT-1A (n=1); another protein pool named "$(\alpha CD20\text{-}scFv::SLT\text{-}1A)_2$ composition" predominantly comprised monospecific, bivalent CD20-binding protein (n=2) and represents an exemplary, multivalent CD20-binding molecule composition of the present invention; and a third protein pool predominantly comprised monospecific, multivalent CD20-binding proteins of various sizes (n=2, 3, 4, 5, 6, etc.) with only a minority of the size of a bivalent CD20-binding protein. The third protein pool was further purified to reduce the amounts of monovalent CD20-binding protein αCD20-scFv::SLT-1A and bivalent CD20-binding protein using a second hydroxyapatite chromatography purification step followed by a size exclusion chromatography step and chromatographic fraction collection. Certain fractions comprising molecular sizes estimated to be large than bivalent CD20-binding protein were pooled to create the exemplary, multivalent CD20-binding molecule composition of the present invention named "$(\alpha CD20\text{-}scFv::SLT\text{-}1A)_{n+2}$ composition" (i.e. n+2≥3). The three protein pools (CD20-binding protein compositions) were individually concentrated.

The protein makeup of each of the three CD20-binding protein compositions (1) αCD20-scFv::SLT-1A, (2) $(\alpha CD20\text{-}scFv::SLT\text{-}1A)_2$, and (3) $(\alpha CD20\text{-}scFv::SLT\text{-}1A)_{n+2}$ was analyzed by size exclusion chromatography (SEC) using a Superdex 200 30/300 column (GE Healthcare, Little Chalfont, Buckinghamshire. U.K.) with a 24 mL bed volume (FIG. 2; Table 1). For the SEC chromatographic analysis, each sample was loaded and then at least 24 mL of buffer was flowed through the column while an ultraviolet (uv) light detector monitored the absorbance at 280 nanometers (nm) of the eluted materials as reported in milli-absorbance units (mAU) (FIG. 2; Table 1). Generally, smaller-sized molecules are retarded when flowing through matrices used for size exclusion chromatography as compared to larger-sized molecules and, therefore, smaller-sized molecules exhibit longer, SEC retention times than larger-sized molecules. Thus, the measuring of SEC retention times can provide an estimate of the relative proportion(s) of differently-sized molecular constituents within in a composition, and, thus, the purity of a composition with regard to molecular constituents of certain sizes.

TABLE 1

Size Exclusion Chromatographic Analysis of Purified Compositions Having Different Forms of αCD20-scFv::SLT-1A: Relative proportions of different monomeric and multimeric αCD20-scFv::SLT-1A structures

| | Monomer | Dimer | Multimers > Dimer |
|---|---|---|---|
| αCD20-scFv::SLT-1A pool | 95.0% | 5.0% | 0.0% |
| (αCD20-scFv::SLT-1A)$_2$ pool | 0.0% | 79.0% | 21.0% |
| (αCD20-scFv::SLT-1A)$_{2+n}$ pool | 3.0% | 9.0% | 88.0% |
| average retention (mL) | 15.5 | 13.8 | 12.1 |

*"Multimers > Dimer" refers to a class of multivalent CD20-binding protein multimers of sizes larger than a dimer Table 1 shows the relative proportions of three different classes of CD20-binding protein present in the protein compositions as differentiated by size: (1) αCD20-scFv::SLT-1A class, (2) (αCD20-scFv::SLT-1A)$_2$ class, and (3) (αCD20-scFv::SLT-1A)+2 class. The αCD20-scFv::SLT-1A composition comprised 95 percent monomeric CD20-binding protein of the total protein present, and each of these monomeric CD20-binding proteins was monovalent for CD20 binding. The (αCD20-scFv::SLT-1A)$_2$ composition did not comprise any measurable amount of monomeric CD20-binding protein instead comprising 100 percent multivalent CD20-binding protein of the total protein present. For the (αCD20-scFv::SLT-1A)$_2$ composition, 79 percent of the protein present was dimeric and 21 percent of the protein present was the size of a multimeric form(s) greater than the size of any dimeric form. Finally, the analysis showed that the (αCD20-scFv::SLT-1A)$_{2+n}$ composition comprised mostly multivalent CD20-binding protein of molecular sizes greater than the size of a dimeric form (88 percent of the total protein was of a size greater than the size of a dimer), but this composition also comprised a minor proportion of dimeric form(s) of multivalent CD20-binding protein and an even smaller proportion of the monomeric CD20-binding protein. The dimeric form(s) of the CD20-binding protein present in these three compositions represent exemplary, multivalent CD20-binding protein(s) of the present invention that are both bivalent and multimeric.

The three CD20-binding protein compositions (1) αCD20-scFv::SLT-1A, (2) (αCD20-scFv::SLT-1A)$_2$, and (3) (αCD20-scFv::SLT-1A)$_{n+2}$ were also analyzed by SDS polyacrylamide gel electrophoresis (SDS-PAGE). A sample from each of the three purified protein compositions was subjected to reducing conditions of 42 millimolar (mM) dithiolthreitol (DTT) and denatured at 95° C. for 5 minutes to investigate the presence of reducible covalent bonds, such as, e.g. cysteine disulfide bonds, linking proteinaceous components of the multivalent CD20-binding proteins present in the compositions. Samples were diluted with 3×SDS Blue Loading Buffer (187.5 mM Tris-HCl (pH 6.8), 6% mass/volume percentage (w/v) sodium dodecyl sulfate (SDS), 30% glycerol and 0.03% (w/v) bromophenol blue, Catalog #B7703S, New England BioLabs, Inc., Ipswich, Mass., U.S.) or 3×SDS Reducing Blue Loading Buffer (187.5 mM Tris-HCl (pH 6.8), 6% (w/v) SDS, 30% glycerol, 0.03% (w/v) bromophenol blue, and 125 mM DTT, Catalog # B7703S, New England BioLabs, Inc., Ipswich, Mass., U.S.) to a final composition of 1× buffer and mixed well. The samples were heated at 95° C. for 5 minutes and then 5 micrograms (μg) of protein sample per well was loaded into wells of a 4-20% SDS polyacrylamide gel and subjected to electrophoresis.

Samples of both reduced and non-reduced purified protein pools were analyzed in denaturing conditions by SDS-PAGE (FIG. 3). FIG. 3 shows images of a Coomassie-stained, 4-20% SDS-PAGE gel (Lonza, Basel, CH) with the lanes of the gel numbered and the figure legend indicating which sample was loaded into each lane by the same respective numbering. Multimeric forms of the multivalent CD20-binding proteins present in a sample whose subunits are associated only from non-covalent interactions were expected to dissociate into their component monovalent proteins in this denaturing gel analysis regardless of redox state due to the nature of the SDS-PAGE technique performed. In contrast, multimeric forms of the multivalent CD20-binding proteins present in a sample that result from reducible covalent bonds, such as, e.g., cysteine disulfide bridge-dependent forms, might be observed to dissociate into proteinaceous components in reduced samples but not in unreduced samples. However, in both situations, incomplete disulfide bond reduction and/or protein denaturation could permit the persistence of multimeric structures.

The electrophoresis analysis showed that the majority proteinaceous species in the αCD20-scFv::SLT-1A composition migrated at a molecular mass of about 55 kDa (FIG. 3), which was the approximate size expected for SEQ ID NO:54, which has an anti-CD20 scFv fused to the Shiga toxin A Subunit effector polypeptide SLT-1A 1-251. The size of this species was unchanged between non-reducing and reducing conditions (FIG. 3). These results were consistent with the majority protein species in the αCD20-scFv::SLT-1A composition as being the monomeric, monovalent CD20-binding protein component of the exemplary, multivalent CD20-binding protein compositions of this Example.

The electrophoresis analysis showed that the majority proteinaceous species in the (αCD20-scFv::SLT-1A)$_2$ composition migrated at a molecular mass of about 110 kDa (FIG. 3, lane 5), which was the approximate size expected for a dimeric form consisting of exactly two of the monomeric, monovalent CD20-binding proteins of the αCD20-scFv::SLT-1A composition. There was also a minority proteinaceous species present in the (αCD20-scFv::SLT-1A)$_2$ composition which migrated at a molecular mass of about 55 kDa under non-reducing conditions and might represent the monomeric, monovalent CD20-binding protein component αCD20-scFv::SLT-1A after the denaturation of a dimeric form(s) that result from one or more non-covalent association(s) but not any covalent linkage(s), such as, e.g., a cysteine disulfide bond. The size of the vast majority of this majority species changed to about 55 kDa under reducing conditions (FIG. 3, lane 5), which was consistent with the existence, under non-reducing conditions, of one or more disulfide bonds linking two, monomeric, monovalent CD20-binding protein molecules together in a dimeric form(s) for the majority protein species present in the (αCD20-scFv::SLT-1A)$_2$ composition.

The electrophoresis analysis showed that the majority proteinaceous species in the (αCD20-scFv::SLT-1A)$_2$+n composition migrated at a molecular mass of about 55 kDa or 110 kDa (FIG. 3, lane 7), which was the approximate size expected for either the monomeric, monovalent CD20-binding protein component αCD20-scFv::SLT-1A or a dimeric form(s) consisting of exactly two monovalent CD20-binding protein components. The size of the vast majority of the dimeric protein species changed to about 55 kDa under reducing conditions (FIG. 3, lane 6), which was consistent with the existence, under non-reducing conditions, of one or more disulfide bonds linking two, monovalent CD20-binding protein molecules together in a dimeric form(s) in the (αCD20-scFv::SLT-1A)$_{2+n}$ composition.

The comparison of the reduced and non-reduced samples electrophoretically separated through SDS-PAGE gels under denaturing showed that the compositions (αCD20-scFv::SLT-1A)$_2$ and (αCD20-scFv::SLT-1A)$_{n+2}$ included both covalent and non-covalent multimers (FIG. 3, lanes 4-7). These exemplary compositions of multivalent CD20-binding proteins of the present invention, (αCD20-scFv::SLT-1A)$_2$ and (αCD20-scFv::SLT-1A)$_{n+2}$ comprise multivalent CD20-binding proteins which have covalently linked, protein subunits and/or non-covalent linked protein subunits.

B. Determining the Cell-Binding Characteristics of Multivalent CD20-Binding Proteins Present in Exemplary Compositions of the Present Invention The binding characteristics of the multivalent CD20-binding protein compositions (αCD20-scFv::SLT-1A)$_2$ and (αCD20-scFv::SLT-1A)$_{n+2}$ to human tumor-derived, cell lines were studied using a fluorescence-based, flow-cytometry assay. The protein compositions (αCD20-scFv::SLT-1A)$_2$ and (αCD20-scFv::SLT-1A)$_{n+2}$, which were produced as described above, were analyzed for the ability of their multimeric, multivalent CD20-binding proteins having Shiga toxin effector regions to bind to human tumor-derived, cell lines that express human CD20 at a cellular surface.

Samples containing CD20 positive (CD20+) Raji cells or CD20 negative (CD20-) U266 cells were suspended in 1×PBS containing one percent bovine serum albumin (BSA) (Calbiochem, San Diego, Calif., U.S.), hereinafter referred to as "1×PBS+1% BSA" and incubated for one hour at 4 degrees Celsius (° C.) with 100 microliters (μL) of various dilutions of the multivalent CD20-binding protein compositions to be assayed. After the one-hour incubation, samples comprising a mixture of cells and a multivalent CD20-binding protein composition were washed twice with 1×PBS+1% BSA. Then the samples were incubated for one hour at 4° C. with 100 μL of 1×PBS+1% BSA solution comprising a murine monoclonal antibody anti-SLT-1A (BEI NR-867 BEI Resources, Manassas, Va., U.S.; cross reactive with Shiga toxin and Shiga-like toxin 1 A subunits) at an antibody concentration larger than the total protein concentration present in each sample. The samples were washed with 1×PBS+1% BSA and then incubated in the same manner with an anti-mouse IgG secondary antibody conjugated with FITC at an antibody concentration larger than the total protein concentration present in each sample. Then the samples were washed twice with 1×PBS+1% BSA, resuspended in 200 μL of 1×PBS, and subjected to fluorescence-based, flow cytometry in order to measure protein binding to the cells.

The maximum specific binding (B$_{max}$) and equilibrium binding constants (K$_D$) of αCD20-scFv::SLT-1A, (αCD20-scFv::SLT-1A)$_2$ and (αCD20-scFv::SLT-1A)$_{n+2}$ samples to human tumor-derived, cell lines were determined as follows. The mean fluorescence intensity (MFI) data from the fluorescence-based, flow cytometry for all the samples was obtained by gating the data using a cell sample incubated only with the secondary antibody as a negative control. Graphs were plotted of the MFI data versus "concentration of protein" using Prism software (GraphPad Software, San Diego, Calif., U.S.) (FIG. 4). Using the Prism software function of one-site binding [Y=B$_{max}$*X/(K$_D$+X)] under the heading binding-saturation, the B$_{max}$ and K$_D$ were calculated using baseline corrected data. Light absorbance (Abs) values were corrected for background by subtracting the Abs values measured for wells containing only PBS. B$_{max}$ is the maximum specific binding reported in MFI. K$_D$ is the equilibrium binding constant, reported in nanograms per milliliter (ng/mL). The K$_D$ and B$_{max}$ values for the compositions (αCD20-scFv::SLT-1A)$_2$ and (αCD20-scFv::SLT-1A)$_{n+2}$ are reported in Table 2 and shown in FIG. 4.

TABLE 2

Binding of Exemplary, Multivalent αCD20-scFv::SLT-1A Compositions of the Invention to CD20+ Raji Cells as Compared to a Monovalent CD20-Binding Protein Composition

| Protein Composition | B$_{max}$ (MFI) | K$_D$ (ng/mL) |
|---|---|---|
| (αCD20-scFv::SLT-1A)$_2$ dimer | 167,728 | 180.2 |
| (αCD20-scFv::SLT-1A)$_{n+2}$ | 147,366 | 176.9 |
| αCD20-scFv::SLT-1A monomer | 178,118 | 544.1 |

The B$_{max}$ for (CD20-scFv::SLT-1A)$_2$ binding to CD20$^+$ Raji cells was measured to be about 170,000 MFI with a K$_D$ of about 180 ng/mL (Table 2; FIG. 4). The B$_{max}$ for (CD20-scFv::SLT-1A)$_{n+2}$ binding to CD20$^+$ Raji cells was measured to be about 150,000 MFI with a K$_D$ of about 180 ng/mL (Table 2; FIG. 4). Thus, exemplary protein compositions of the present invention (αCD20-scFv::SLT-1A)$_2$ and (αCD20-scFv::SLT-A)$_{n+2}$ (which were predominantly composed of multimeric, multivalent CD20-binding proteins) both exhibited high-affinity binding to human CD20-expressing human cells expressing CD20 at a cell surface (e.g. CD20$^+$ human cells). It is unknown whether any multimeric form of CD20-scFv::SLT-1A present in either the (αCD20-scFv::SLT-1A)$_2$ or (αCD20-scFv::SLT-1A)$_{n+2}$ compositions is capable of simultaneously binding two, different, CD20 target biomolecules present at the cell surface of a single, CD20-expressing cell.

C. Determining the Half-Maximal Inhibitory Concentration (IC$_{50}$) of the Proteins (αCD20-scFv::SLT-1A)$_2$ and (αCD20-scFv::SLT-1A)$_{n+2}$ to Eukaryotic Ribosomes In Vitro The ribosome inactivation capabilities of the (αCD20-scFv::SLT-1A)$_2$ and (αCD20-scFv::SLT-1A)$_{n+2}$ protein compositions were determined in a cell-free, in vitro protein translation assay using the TNT® Quick Coupled Transcription/Translation Kit (L1170 Promega, Madison, Wis., U.S.). The kit includes Luciferase T7 Control DNA and TNT® Quick Master Mix. The ribosome activity reaction was prepared according to the manufacturer's instructions to create "TNT" reaction mixtures. The concentrations of CD20-binding protein present in the samples were calculated based on the molarity of the SLT-1A components (see below). A series of 10-fold dilutions of the CD20-binding protein compositions to be analyzed was prepared in an appropriate buffer, and a series of identical TNT reaction mixture components was created for each sample dilution.

Each sample in the dilution series was combined with each of the TNT reaction mixtures along with the Luciferase T7 Control DNA. The test samples were incubated for 1.5 hours at 30° C. After the incubation. Luciferase Assay Reagent (E1483 Promega, Madison, Wis., U.S.) was added to all test samples, and the amount of luciferase protein translation was measured by luminescence according to the manufacturer's instructions. The level of translational inhibition was determined by non-linear regression analysis of log-transformed molar concentrations of the total protein, estimated based on the normalized molar concentration of Shiga toxin protein versus relative luminescence units. Using statistical software (GraphPad Prism, San Diego, Calif., U.S.), the half maximal inhibitory concentration ($IC_{50}$) in picomolar (pM) value was calculated for each CD20-binding protein composition tested (FIG. 5: Table 3).

TABLE 3

Ribosome Inactivation Analysis: Representative half-maximal inhibitory concentrations ($IC_{50}$) of multivalent CD20-binding proteins of the invention as compared to a monovalent CD20-binding protein

| Protein | $IC_{50}$ (pM) |
|---|---|
| (αCD20-scFv::SLT-1A)$_2$ | 5.29 |
| (αCD20-scFv::SLT-1A)$_{n+2}$ | 10.74 |
| αCD20-scFv::SLT-1A monomer | 3.14 |
| SLT-1 A (1-251) only positive control | 3.15 |

The inhibitory effects of the exemplary, multivalent CD20-binding protein compositions (CD20-scFv::SLT-1A)$_2$ and (CD20-scFv::SLT-1A)$_{n+2}$ on cell-free protein synthesis were strong (FIG. 5; Table 3). Dose-dependence experiments determined that the $IC_{50}$ values of the multivalent CD20-binding molecules present in (CD20-scFv::SLT-1A)$_2$ and (CD20-scFv::SLT-1A)$_{n+2}$ to protein synthesis in this cell-free assay were about 5.3 pM and 11 pM, respectively (FIG. 5; Table 3).

D. Determining the Half-Maximal Cytotoxic Concentrations ($CD_{50}$) of the Multivalent CD20-Binding Proteins (αCD20-scFv::SLT-1A)$_2$ and (αCD20-scFv::SLT-1A)$_{n+2}$ Using a CD2+ Cell-Kill Assay Dose dependence experiments were used to determine the $CD_{50}$ values of the exemplary, multivalent CD20-binding protein compositions of the present invention (αCD20-scFv::SLT-1A)$_2$ and (αCD20-scFv::SLT-1A)$_{n+2}$. The cytotoxicity characteristics of the (αCD20-scFv::SLT-1A)$_2$ and (αCD20-scFv::SLT-1A)$_{n+2}$ compositions were determined by the following CD20+ cell-kill assay. This assay determines the capacity of a protein sample to kill cells expressing at a cellular surface the CD20 target biomolecule of the multivalent CD20-binding protein's binding region(s). CD20+ Raji cells and CD20+ ST486 cells were plated ($7.5 \times 10^3$ cells per well) in 20 µL cell culture medium in 384-well plates. The multivalent CD20-binding protein compositions to be tested were diluted 10-fold in a 1×PBS, and 5 µL of the dilutions were added to the CD20+ and CD20− cell samples in the 384-well plates. Control wells containing only cell culture medium were used for baseline correction. The cell samples were incubated with protein samples or just buffer for three days at 37° C. and in an atmosphere of 5% carbon dioxide ($CO_2$). The total cell survival or percent viability was determined using a luminescent readout using the CellTiter-Glo® Luminescent Cell Viability Assay (G7573 Promega Madison, Wis., U.S.) according to the manufacturer's instructions. The Percent Viability of experimental wells was calculated using the following equation: (Test RLU−Average Media RLU)/(Average Cells RLU−Average Media RLU)*100. Log polypeptide concentration versus Percent Viability was plotted in Prism (GraphPad Prism, San Diego, Calif., U.S.) and log (inhibitor) vs. response (3 parameter) analysis were used to determine the half-maximal cytotoxic concentration ($CD_{50}$) value for the multivalent CD20-binding protein compositions (αCD20-scFv::SLT-1A)$_2$ and (αCD20-scFv::SLT-1A)$_{n+2}$ to CD20+ cells.

The $CD_{50}$ value of (αCD20-scFv::SLT-1A)$_2$ composition to CD20+ Raji cells was 250 ng/mL (Table 4; FIG. 6). The $CD_{50}$ value of the composition (αCD20-scFv::SLT-1A)$_{n+2}$ to CD20+ Raji cells was about 220 ng/mL (Table 4; FIG. 6). In contrast, the $CD_{50}$ value of the monomeric, monovalent CD20-binding protein composition αCD20-scFv::SLT-1A was much higher (i.e. less potent) such that at the tested concentrations a $CD_{50}$ could not be accurately determined from the shape of the curve (Table 4, "NC" denotes not calculable; FIG. 6). For the protein concentrations and cell densities tested in this assay, it was estimated that at certain concentrations of the proteins tested, the available cell-surface CD20 present could be saturated by CD20-binding protein (see, Muller P, Brennan F, Clin Pharmacol Ther 85: 247-58 (2009), for an exemplary "RO model" used to estimate occupancy).

TABLE 4

Cytotoxicity: Representative half-maximal cytotoxic concentrations ($CD_{50}$) for exemplary, multivalent CD20-binding protein compositions of the present invention to CD20+ Raji Cells

| Protein | $CD_{50}$ (ng/mL) |
|---|---|
| (αCD20-scFv::SLT-1A)$_2$ | 249.0 |
| (αCD20-scFv::SLT-1A)$_{n+2}$ | 217.7 |
| αCD20-scFv::SLT-1A | NC* |

*"NC" (not calculable) indicates that an accurate $CD_{50}$ could not be calculated based on the shape of the curve.

Using the same cell-kill assay, the (αCD20-scFv::SLT-1A)$_2$ protein composition was shown in other experiments to be nontoxic to CD20 negative cell lines, such as, e.g., BC-1, U266, and H929 cells, when tested at similar cell densities and CD20-binding protein concentrations, which included protein concentrations as high as 40,000 ng/mL. Also using the same cell-kill assay, both the SLT-1A (1-251) component alone and the monomeric, monovalent CD20-binding protein composition αCD20-scFv::SLT-1A did not exhibit specific cytotoxicity toward CD20+ Raji cells at protein concentrations as large as 24,000 ng/mL.

The cytotoxicity measurements of the monovalent CD20-binding protein composition αCD20-scFv::SLT-1A showed that αCD20-scFv::SLT-1A exhibited no greater cytotoxicity towards CD20+ Raji cells at the tested cell density and protein concentrations compared with the cytotoxicity of an SLT-1A (1-251) "only" negative control sample, which lacked any cell-targeting moiety like a cell-surface receptor binding region. Thus, the monovalent CD20-binding protein composition αCD20-scFv::SLT-1A exhibited only non-specific cytotoxicity regardless of cell-surface marker expression. In conclusion, the monovalent CD20-binding protein αCD20-scFv::SLT-1A was incapable of killing CD20+ cells at the protein concentrations tested; whereas, the exemplary, multivalent CD20-binding protein compositions of the present invention (αCD20-scFv::SLT-1A)$_2$ and (αCD20-scFv::SLT-1A)$_{n+2}$ showed potent, cell-targeted cytotoxicity specifically to CD20-expressing cells.

To further investigate these unexpected results, the protein compositions αCD20-scFv::SLT-1A and (αCD20-scFv::SLT-1A)$_2$ were mixed together to form new compositions to test the cytotoxic potency of their constituent CD20-binding proteins as a function of the ratio of CD20-binding protein constituents. The (αCD20-scFv::SLT-1A)$_2$ composition comprised 100% multivalent CD20-binding protein of the total protein present and 79% of that multivalent CD20-binding protein was bivalent CD20-binding protein (see Table 1, supra). The αCD20-scFv::SLT-1A composition comprised 95% monovalent CD20-binding protein of the total protein present (see Table 1, supra). Increasingly larger samples of the multivalent CD20-binding molecule composition (αCD20-scFv::SLT-1A)$_2$ were added to samples of the monovalent CD20-binding protein composition αCD20-scFv::SLT-1A to create a series of mixed samples with total protein concentration ratios of 1:3, 1:1, and 3:1 of the (αCD20-scFv::SLT-1A)$_2$ composition to the αCD20-scFv::SLT-1A composition. Samples of the fixed-ratio, mixed samples, along with samples of the original, unmixed αCD20-scFv::SLT-1A and (αCD20-scFv::SLT-1A)$_2$ compositions, were tested using the CD20+ cell-kill assay as described above to determine each sample's $CD_{50}$ value to CD20-expressing cells (ST486). The results are shown in FIG. 7, FIG. 8, and Table 5, along with the results for the unmixed αCD20-scFv::SLT-1A and (αCD20-scFv::SLT-1A)$_2$ compositions. In addition, none of these samples exhibited cytotoxicity toward CD20 negative cells using this assay at the concentrations tested (FIG. 9).

TABLE 5

Cytotoxicity: Representative half-maximal cytotoxic concentrations ($CD_{50}$) for the multivalent (αCD20-scFv::SLT-1A)$_2$ composition diluted with increasingly more of the monovalent αCD20-scFv::SLT-1A composition

| Protein | $CD_{50}$ (ng/mL) |
|---|---|
| 1:0 (αCD20-scFv::SLT-1A)$_2$ | 61.5 |
| 3:1 (αCD20-scFv::SLT-1A)$_2$ to αCD20-scFv::SLT-1A | 74.9 |
| 1:1 (αCD20-scFv::SLT-1A)$_2$ to αCD20-scFv::SLT-1A | 108.0 |
| 1:3 (αCD20-scFv::SLT-1A)$_2$ to αCD20-scFv::SLT-1A | 213.0 |
| 0:1 αCD20-scFv::SLT-1A | 967.0 |
| unpurified (αCD20-scFv::SLT-1A)$_2$ | 142.0 |

FIG. 7 shows the CD20+ cell-kill assay results for the exemplary, multivalent CD20-binding molecule composition of the present invention (αCD20-scFv::SLT-1A)$_2$, the monovalent CD20-binding protein composition αCD20-scFv::SLT-1A and the "unpurified" protein composition (αCD20-scFv::SLT-1A)$_n$ described above before any copper sulfate oxidation step.

FIG. 8 shows the CD20+ cell-kill assay results for the fixed-ratio mixtures of a 1:3 protein concentration ratio of (αCD20-scFv::SLT-1A)$_2$ to αCD20-scFv::SLT-1A, a 1:1 protein concentration ratio of (αCD20-scFv::SLT-1A)$_2$ to αCD20-scFv::SLT-1A, and a 3:1 protein concentration ratio of (αCD20-scFv::SLT-1A)$_2$ to αCD20-scFv::SLT-1A, along with the original, multivalent CD20-binding protein composition (αCD20-scFv::SLT-1A)$_2$.

Table 5 reports the $CD_{50}$ values for samples of the purified (αCD20-scFv::SLT-1A)$_2$ composition, the mixture of a 1:3 protein concentration ratio of (αCD20-scFv::SLT-1A)$_2$ to αCD20-scFv::SLT-1A, the mixture of a 1:1 protein concentration ratio of (αCD20-scFv::SLT-1A)$_2$ to αCD20-scFv::SLT-1A, the mixture of a 3:1 protein concentration ratio of (αCD20-scFv::SLT-1A)$_2$ to αCD20-scFv::SLT-1A, and "unpurified" (αCD20-scFv::SLT-1A)$_n$. Table 5 shows the cytotoxicity of the purified, multivalent CD20-binding molecule composition (αCD20-scFv::SLT-1A)$_2$ to CD20-expressing cells was about 16 times greater than the cytotoxicity of the purified, monovalent CD20-binding protein composition αCD20-scFv::SLT-1A to CD20-expressing cells. Table 5 shows the (αCD20-scFv::SLT-1A)$_2$ composition was about 2.3 times more cytotoxic than the "unpurified" (αCD20-scFv::SLT-1A)$_n$ composition from which the (αCD20-scFv::SLT-1A)$_2$ composition was purified.

The $CD_{50}$ values in Table 5 were graphed as a function of the percentage of (αCD20-scFv::SLT-1A)$_2$ composition protein of the total protein in the sample tested, and a straight line was fitted to the data points using a simple linear regression, statistical model (FIG. 10). The coefficient of determination ("R squared") of the line fit was 0.8424. In FIG. 11, the $CD_{50}$ values represented in Table 5 were graphed as a function of the percentage of (αCD20-scFv::SLT-1A)$_2$ composition protein of the total protein in the sample.

The results reported in Table 5, FIG. 10, and FIG. 11 show that as the multivalent CD20-binding protein composition (αCD20-scFv::SLT-1A)$_2$ was diluted with the monovalent CD20-binding protein composition αCD20-scFv::SLT-1A, the cytotoxicity of the mixed CD20-binding protein samples was reduced, such as, e.g., by 4-fold or greater, as assayed by $CD_{50}$ values measured with the CD20+ cell-kill assay. FIGS. 10 and 11 show that as the relative protein concentration of the multivalent CD20-binding protein composition (αCD20-scFv::SLT-1A)$_2$ increases over the total CD20-binding protein concentration, the cytotoxic potency of the mixture to CD20+ cells increased (represented by lower $CD_{50}$ values). The cytotoxicity of the (αCD20-scFv::SLT-1A)$_2$ composition to CD20+ cells was diluted in linear manner by the addition of more and more of the monovalent CD20-binding protein composition αCD20-scFv::SLT-1A (see FIGS. 8, 10, and 11). Thus, for achieving more maximal cytotoxicity of a multivalent CD20-binding protein composition of the present invention, the amount of any monovalent CD20-binding protein (e.g., αCD20-scFv::SLT-1A or (αCD20-scFv::SLT-1A)$_n$ where n=1) or the relative proportion monovalent CD20-binding protein to total CD20-binding protein should be minimized or eliminated because a monovalent CD20-binding protein represents a cytotoxicity-lowering constituent of the composition, such as, e.g., by functioning as a non-cytotoxic impurity or a constituent having significantly lower cytotoxicity than a multivalent CD20-binding molecule comprising it as a component.

Considering that the in vitro, ribosome inhibitory activities of both monovalent and multivalent variants of the CD20-binding protein compositions were similar (see Table 3), it was expected that changes in CD20-expressing cell binding caused by differences in CD20-binding valency would account for any differences in cytotoxic potency between monovalent and multivalent CD20-binding protein. However, the lack of cytotoxic potency of the monovalent CD20-binding protein composition αCD20-scFv::SLT-1A as compared to the (αCD20-scFv::SLT-1A)$_2$ composition cannot be explained merely by the difference in CD20+ cell-binding between the αCD20-scFv::SLT-1A composition and the (αCD20-scFv::SLT-1A)$_2$ composition (see Table 2 and FIG. 4).

Using the same cell-kill assay, the fixed-ratio mixtures of CD20-binding protein compositions were analyzed for cytotoxicity to CD20 negative H929 cells (FIG. 9). The $CD_{50}$ values of the mixture of a 1:3 protein concentration ratio of (αCD20-scFv::SLT-1A)$_2$ to αCD20-scFv::SLT-1A, the mixture of a 1:1 protein concentration ratio of (αCD20-scFv::SLT-1A)$_2$ to αCD20-scFv::SLT-1A, and the mixture of a 3:1 protein concentration ratio of (αCD20-scFv::SLT-1A) to αCD20-scFv::SLT-1A to target negative cells were not calculable because of the shape of the curve produced by the dilution series. Thus, the fixed-ratio mixtures were not cytotoxicity to CD20 negative cells at the concentrations tested; whereas, each ratio tested showed some levels of targeted cytotoxicity to CD20+ cells (Table 5; FIG. 9).

In addition, CD20+ cell-kill assays were performed as described above to test the cytotoxicity of protein compositions comprising purified, catalytically inactive, bivalent CD20-binding protein. Protein compositions, which comprised multivalent CD20-binding protein, were produced as described above for the purification and production of the composition (αCD20-scFv::SLT-1A)$_2$. The Shiga toxin effector polypeptide regions of the CD20-binding proteins of these compositions were catalytically inactive or catalytically impaired due to the presence of the mutation(s) E167D, Y77S, or Y77S/E167D in their Shiga toxin effector regions. The multivalent CD20-binding proteins of these compositions comprised the monovalent CD20-binding protein αCD20-scFv::SLT-1A (SEQ ID NO:54) with at least one of the mutations noted above for studying the role of catalytic activity. The catalytically inactive variants of the multivalent CD20-binding proteins were not cytotoxic at the concentrations tested. Without being bound by theory. the requirement for a catalytically active, Shiga toxin effector region for cell-killing by multivalent CD20-binding molecules of this Example showed the mechanism of cytotoxicity of certain, multivalent CD20-binding molecule of this invention, and compositions thereof, 1) is Shiga toxin effector region dependent, 2) requires the Shiga toxin activity of ribosome inactivation within the target cell, and 3) does not involve any other cytotoxic effect of the multivalent CD20-binding molecule independent of Shiga toxin effector catalytic activity (i.e., no other cytotoxic effect of the multivalent CD20-binding molecule (e.g., a Shiga toxin effector region-independent, extracellular, cytotoxic effect) was observed in the assays of this Example at the protein concentrations tested in the absence of Shiga toxin effector region catalytic activity.

E. Determining Relative Proportions of Multivalent CD20-Binding Molecules in Exemplary Compositions of the Present Invention Chromatographic and/or electrophoretic methods known to the skilled worker were used to determine 1) relative protein concentration ratios of different CD20-binding proteins within exemplary compositions of the present invention.

In this Example, SEC analyses were used to analyze the amount of proteinaceous species of different sizes present in exemplary compositions of the present invention, e.g., the ratios and/or percentages between monovalent, bivalent, and higher-order multivalent CD20-binding species were calculated.

SEC analyses were performed using the following assays. Samples were loaded onto a fast protein liquid chromatography (FPLC) column and buffer was flowed through the column while the absorbance at 280 nm of the eluted materials was recorded in mAU. Using the same column and setup, molecules of known sizes and migration characteristics (standards) were analyzed in order to calibrate which retention times corresponded to which protein sizes and/or protein sizes were predicted from the amino acid composition of each monovalent CD20-binding protein monomer present in the composition to be analyzed. Chromatographic data collected from commercial size standards were used to create calibration curves to help estimate sizes of molecular species in samples and focus analyses on specific retention time ranges. In certain instances of high purity, the total protein quantity for a given composition was estimated using the absorbance measurement at 280 nm from a SEC analysis, the predicted molecular weight of the majority molecular species present, and the extinction coefficient of that majority species.

In addition, SDS-PAGE and/or capillary gel electrophoretic analyses of both reduced and non-reduced samples was used to verify the sizes, estimate the relative quantities, and detect any disulfide bond, multimeric associations present in the molecular species of a given size or peak (see e.g. FIG. 3). For example, the size of a molecule in a SEC peak can be estimated based on non-reducing SDS-PAGE analysis of chromatographic fractions collected at retention times within that peak's retention duration.

In this Example, all the multivalent CD20-binding proteins in the exemplary compositions of the present invention consisted essentially of multimeric forms of monovalent CD20-binding protein. Thus, peaks and bands corresponding to species: 1) the same size of the monovalent CD20-binding protein were composed of monovalent CD20-binding molecule, 2) twice as large as the monovalent CD20-binding protein were composed of bivalent CD20-binding molecule(s), 3) three times as large as the monovalent CD20-binding protein were composed of trivalent CD20-binding molecule(s), and so forth.

Some SEC analyses involved assays performed with an ÄKTA system (GE Healthcare, Little Chalfont, Buckinghamshire, U.K.). UNICORN™ control software (GE Healthcare, Little Chalfont, Buckinghamshire, U.K.) was used to calculate the protein concentration percentages of different sized-species using the software's peak integration functions, which included baseline calculation, determination of the start and end of peaks, the retention time and the area under the curve. The identity of the CD20-binding protein species represented by a peak in the 280 nm trace from a chromatographic analysis were manually assigned based on the expected retention time determined using calibration standards (e.g. a gel filtration standard like GE Healthcare Life Science's product 28-4038-42 Gel Filtration HMW Calibration Kit).

Other SEC analyses involved a similar assay performed with a Waters system (Waters Corp., Milford, Mass., U.S.). SEC analysis was performed using a Waters Alliance HPLC system running Water Empower 2 software (Waters Corp., Milford, Mass., U.S.). The HPLC system included an analytical TSKgel G3000SW$_{XL}$ size-exclusion column and a TSKgel Guard SW$_{XL}$ size-exclusion guard column (Tosoh Bioscience LLC, King of Prussia. Pa., U.S.). Prior to use, the columns were equilibrated with mobile phase (20 mM sodium phosphate, 500 mM sodium chloride, pH 7.4) for at least thirty minutes at a flow rate of 0.5 mL per minute (mL/min). A blank sample of 100 µL of mobile phase was run through the columns to check the system was clean and working properly. Then composition samples were analyzed, including samples of known protein size standards (e.g. a commercially available, gel filtration standard like GE Healthcare Life Science's product 28-4038-42 Gel Filtration HMW Calibration Kit). For each composition sample, 50 µg of protein was injected and an isocratic pump was run for thirty minutes at a flow-rate of 0.5 mL per minute though the columns at a temperature of 22° C.

The percentages of multivalent CD20-binding molecule present in three, different, exemplary compositions of the present invention were analyzed by SEC using the Waters system (see FIG. 12A, FIG. 12B, and FIG. 12C), and the respective results of these analyses are shown in Tables 6-8. In this Example for the Waters system, a retention time of (1) about 19 to 20 minutes represented a molecular size equivalent to dimeric, bivalent CD20-binding protein (αCD20-scFv::SLT-1A)$_2$; (2) about 20 to 22 minutes represented a molecular size equivalent to the monomeric, monovalent CD20-binding protein αCD20-scFv::SLT-1A; (3) about 17 to 17.5 minutes represented a molecular size equivalent to multimeric CD20-binding proteins which were trivalent or tetravalent; and 4) about 17 minutes represented a molecular size equivalent to multimeric, hexavalent CD20-binding protein. The percent purity of the dimeric, bivalent CD20-binding protein (αCD20-scFv::SLT-1A)$_2$ was calculated from its peak area divided by the total peak area of all peaks from 14 to 27 minutes. The percentage of each peak to all peaks (Percent Area of Total) was determined using the sum of all peak areas as the denominator as shown in the following formula: (area under the curve of the peak of interest)/(sum of all areas under all peaks)×100.

TABLE 6

SEC Analysis of Exemplary, Multivalent CD20-Binding Molecule Composition #1

| Peak Number | Peak Retention Time (minutes) | Peak Height (AU) | Peak Area | Percent Area of Total (%) |
| --- | --- | --- | --- | --- |
| #1 | 17.12 | 11,120 | 870,189 | 8.79 |
| #2 | 17.55 | 11,947 | 546,273 | 5.52 |
| #3 | 19.30 | 162,857 | 7,713,993 | 77.88 |
| #4 | 20.65 | 14,999 | 774,762 | 7.82 |

TABLE 7

SEC Analysis of Exemplary, Multivalent CD20-Binding Molecule Composition #2

| Peak Number | Peak Retention Time (minutes) | Peak Height (AU) | Peak Area | Percent Area of Total (%) |
| --- | --- | --- | --- | --- |
| #1 | 17.49 | 9,138 | 597,819 | 7.51 |
| #2 | 19.32 | 148,854 | 7,003,742 | 87.95 |
| #3 | 20.87 | 6,418 | 361,658 | 4.54 |

TABLE 8

SEC Analysis of Exemplary, Multivalent CD20-Binding Molecule Composition #3

| Peak Number | Peak Retention Time (minutes) | Peak Height (AU) | Peak Area | Percent Area of Total (%) |
| --- | --- | --- | --- | --- |
| #1 | 17.57 | 7,148 | 381,654 | 4.74 |
| #2 | 19.52 | 128,928 | 7,264,891 | 90.26 |
| #3 | 20.87 | 8,268 | 402,467 | 5.00 |

The results of the Percent Area of Total calculations shown in Tables 6-8 are based on the SEC profile data shown in FIGS. 12A, 12B, and 12C. Table 6 shows the results for one, exemplary, multivalent CD20-binding molecule composition of the present invention having a bivalent CD20-binding protein percentage of total protein of approximately 78%, as well as comprising about 8% monovalent CD20-binding protein and 14% relatively large valence, CD20-binding protein of the total protein. Table 7 shows the results for a second, exemplary, multivalent CD20-binding molecule composition of the present invention having a bivalent CD20-binding protein percentage of total protein approximately 88%, as well as comprising about 4.5% monovalent CD20-binding protein and 7.5% relatively large valence, CD20-binding protein of the total protein. Table 8 shows the results for an exemplary, multivalent CD20-binding molecule composition of the present invention having a bivalent CD20-binding protein percentage of total protein of approximately 90%, as well as comprising about 5% monovalent CD20-binding protein and 5% relatively large valence, CD20-binding protein of the total protein.

One exemplary, multivalent CD20-binding molecule composition of the present invention ("multivalent CD20-binding molecule composition #1") was analyzed 59 different times over an eighteen-month period using the SEC-HPLC Waters system assay described above. The peak areas and total peak area were determined using the software analysis as described above with the minimum retention time set around 14 minutes (near the exclusion limit where molecules are too large to have any significant probability of penetrating the fractionation gel) and the maximum retention time set around 22-27 minutes, depending on calibration measurements of gel filtration standard markers and the multivalent CD20-binding molecule composition's solvent, which is near when molecules of sizes smaller than polypeptides flow off the column. The resulting empirical measurements produced a data set (n=59) describing peak #3 (bivalent CD20-binding protein of the present invention) area to total peak (total protein) area (Percent Area of Total) with a mean of 77.40(%), a median of 77.72(%), a mode of 76.10(%), a standard deviation of 1.533, and a relative standard deviation of 1.982. An exemplary, individual analysis of the exemplary, multivalent CD20-binding molecule composition #1 is shown in Table 6 and FIG. 12A.

F. Determining the In Vivo Effects of Multivalent CD20-Binding Molecule Compositions (αCD20-scFv::SLT-1A)$_2$ and (αCD20-scFv::SLT-1A)$_{n+2}$ Using Animal Models Using methods known to the skilled worker, animal models are used to determine the in vivo effects of the exemplary compositions (αCD20-scFv::SLT-1A)$_2$ and (αCD20-scFv::SLT-1A)$_{n+2}$ on CD20+ neoplastic and/or immune cells (see e.g. WO 2014/164680). Various mice strains are used to test the effects of the multivalent CD20-binding molecules of the present invention, and compositions thereof, after intravenous administration on xenograft tumors in mice resulting from the injection into those mice of human neoplastic cells which express CD20 on at least one of their cell surfaces. Non-human primates are used to test the effects of the multivalent CD20-binding molecule compositions on CD20+ B-cell populations after intravenous administration.

SUMMARY

Surprisingly, multivalent CD20-binding molecules of the present invention, which each comprise cell-targeting, CD20 binding regions and Shiga toxin A subunit effector polypeptide regions, exhibit an unexpected improvement in CD20-expressing cell-kill activity compared to their monovalent protein component.

Given their similar ribosome inactivation activities, it was expected that differences in cytotoxic potencies between monovalent and multivalent variants would be predominantly if not completely explained by differences in the variants' abilities to binding CD20-expressing cells. The difference in $K_D$ values for binding CD20-expressing cells between the bivalent CD20-binding molecule composition (CD20-scFv::SLT-1A)$_2$ of this Example and the monovalent CD20-binding protein composition αCD20-scFv::SLT-1A was about 3-fold with the bivalent CD20-binding molecule composition exhibiting the lower $K_D$ value or about a three times greater binding affinity (Table 2; FIG. 4). Thus, if cytotoxic potency of CD20-binding molecule was directly related to the $K_D$ of cell binding, then the cytotoxicity of the monovalent CD20-binding protein composition was predicted to be at most 3-fold less cytotoxic to CD20+ cells than the exemplary, bivalent CD20-binding molecule composition-meaning the expected $CD_{50}$ value of the monovalent CD20-binding protein should be no more than about three times the $CD_{50}$ value of the exemplary, bivalent CD20-binding molecule composition.

However, it was discovered instead that the monovalent CD20-binding protein composition did not exhibit a cytotoxicity within ten-fold of the cytotoxicity of compositions of multivalent CD20-binding molecules having that same monovalent CD20-binding protein as its only component. Surprisingly, the difference in cytotoxicity was qualitatively increased as by the assay described above, and this cytotoxic difference, while over ten-fold, has yet to be accurately quantified. Without being bound by theory, the increased cytotoxicity of the multivalent CD20-binding protein compositions of this Example might be caused by a qualitative change in the ability of multivalent CD20-binding molecules compared to monovalent CD20-binding molecules to do one or more of the following: 1) internalize into CD20-expressing cells, such as, e.g., with relatively great efficiency; 2) intracellular route to subcellular compartment(s) favorable for effectuating Shiga toxin effector polypeptide mediated cytotoxicity, such as, e.g., with relatively great efficiency; and/or 3) delivery of Shiga toxin effector polypeptides to the cytosol of cell in which the multivalent CD20-binding molecule is present, such as, e.g., with relatively great efficiency.

Example 2. Multivalent CD20-Binding Molecules Derived from Shiga Toxins and Various Immunoglobulin-Type Binding Regions, and Enriched Compositions Thereof In this Example, exemplary compositions of the present invention are created with multivalent CD20-binding proteins derived from Shiga toxin. A Shiga toxin effector region is derived from the A subunit of Shiga-like Toxin 1 (SLT-1A) (SEQ ID NO: 1), Shiga toxin (StxA) (SEQ ID NO:2), and/or Shiga-like Toxin 2 (SLT-2A) (SEQ ID NO:3) or chosen from a Shiga toxin effector known in the art (see e.g., WO 2005/092917, WO 2007/033497. US 2013/196928. WO 2014/164680, WO 2014/164693. WO 2015/113005, WO 2015/113007, WO 2015/138435, WO 2015/138452, US 2015/259428. WO 2015/191764, and U.S. Ser. No. 14/965, 882, each of which is incorporated herein by reference in its entirety). An immunoglobulin-type binding region is derived from the CD20-binding molecule chosen from Table 9 and which binds an extracellular part of CD20. The exemplary, multivalent CD20-binding molecules of this Example are created using techniques known in the art and/or as described in the previous Example. In addition, exemplary compositions enriched for these exemplary, multivalent CD20-binding molecules relative to monovalent CD20-binding molecule(s) are created using techniques known in the art and/or as described in the previous Example such that the compositions have a concentration ratio of monovalent CD20-binding molecule to total CD20-binding molecule concentration of less than one to three. The exemplary, multivalent CD20-binding molecules, and compositions thereof, of this Example are tested as described in the previous Example and/or using assays known to the skilled worker.

TABLE 9

Exemplary CD20 Binding Domains
Source of CD20 Binding Domain

| | |
|---|---|
| monoclonal antibody IF5 and derivatives such as, e.g., humanized variants and immunoglobulin-derived binding domains like scFvs | See e.g. Golay J et al., *J Immunol* 135: 3795-801 (1985); Press O et al., *Blood* 69: 584-91 (1987) |
| monoclonal antibody 1H4 and derivatives such as, e.g., humanized variants and immunoglobulin-derived binding domains like scFvs | See e.g. Haisma H et al., *Blood* 92: 184-90 (1998) |
| monoclonal antibody 1K1791 and derivatives such as, e.g., humanized variants and immunoglobulin-derived binding domains like scFvs | See e.g. Nishida M et al., *Intl J Oncol* 32: 1263-74 (2008) |
| monoclonal antibody 2B8, Leu16, Leuδ, and derivatives such as, e.g., humanized variants and immunoglobulin-derived binding domains like scFvs | See e.g. Reff M et al., *Blood* 83: 435-45 (1994); Maloney D et al., *Blood* 84: 2457-66 (1994); WO 2005016969 |
| monoclonal antibody 2F2 and derivatives such as, e.g., humanized variants and immunoglobulin-derived binding domains like scFvs | See e.g. Teeling J et al., *Blood* 104: 1793-800 (2004) |
| monoclonal antibody 2H7 and derivatives such as, e.g., humanized variants and immunoglobulin-derived binding domains like scFvs | See e.g. Liu A et al., *Proc Natl Acad Sci* 84: 3439-43 (1987); Polyak M et al., *Blood* 99: 3256-62 (2002); Nickerson-Nutter C et al., *Rheumatology* 50: 1033-44 (2011) |
| monoclonal antibody 7D8 and derivatives such as, e.g., humanized variants and immunoglobulin-derived binding domains like scFvs | See e.g. Teeling J et al., *Blood* 104: 1793-800 (2004) |
| monoclonal antibody 8E4 and derivatives such as, e.g., humanized variants and immunoglobulin-derived binding domains like scFvs | Wu L et al., *Cancer Lett* 292: 208-14 (2010) |

TABLE 9-continued

Exemplary CD20 Binding Domains
Source of CD20 Binding Domain

| | |
|---|---|
| monoclonal antibody 11B8 and derivatives such as, e.g., humanized variants and immunoglobulin-derived binding domains like scFvs | See e.g. Boross P et al., *Haematologica* 96: 1822-30 (2011) |
| monoclonal antibody AME-133v, LY2469298, and derivatives such as, e.g., humanized variants and immunoglobulin-derived binding domains like scFvs | See e.g. Robak T. Robak E, *BioDrugs* 25: 13-25 (2011) |
| antibodies recognizing the phosphor-CD20 antigen B1, B-ly1 and derivatives such as, e.g., humanized variants and immunoglobulin-derived binding domains like scFvs | See e.g. Golay et al., *J Immunol* 135: 3795-801 (1985); Tedder T et al., *Eur J Immunol* 16: 881-7 (1986); Cardarelli P et al., *Cancer Immunol Immunother* 51: 15-24 (2002); U.S. Pat. No. 5,843,398 |
| monoclonal antibody B9E9 and derivatives such as, e.g., humanized variants and immunoglobulin-derived binding domains like scFvs | See e.g. Schultz J et al., *Cancer Res* 60: 6663-9 (2000) |
| BM-ca and derivatives such as, e.g., humanized variants and immunoglobulin-derived binding domains like scFvs ( | See e.g. Kobayashi H et al., *Cancer Med* 2: 130-43 (2013) |
| monoclonal antibody C2B8 and derivatives such as, e.g, humanized variants and immunoglobulin-derived binding domains like scFvs | See e.g. Reff M et al., *Blood* 83: 435-45 (1994) |
| monoclonal antibody CKI and derivatives such as, e.g., humanized variants and immunoglobulin-derived binding domains like scFvs | See e.g. Hooijbera E et al., *Cancer Res* 55: 840-6 (1995); Hooijberg E et al., *Hybridoma* 15: 23-31 (1996) |
| GA101, RO5072759, and derivatives such as, e.g., humanized variants and immunoglobulin-derived binding domains like scFvs | See e.g. Mössner E et al., *Blood* 115: 4393-402 (2010); Alduaij W et al., *Blood* 117: 4519-29 (2011); Robak T, Robak E, *BioDrugs* 25: 13-25 (2011); Salles G et al., *Blood* 119: 5126-32 (2012) |
| monoclonal antibody LT20 and derivatives such as, e.g., humanized variants and immunoglobulin-derived binding domains like scFvs | See e.g. de Boer O et al., *PLoS One* 2: e779 (2007) |
| ibritumomab and derivatives such as, e.g., humanized variants and immunoglobulin-derived binding domains like scFvs | See e.g. Wiseman G et al., *Clin Cancer Res* 5: 3281s-3286s (1999); Cang S et al., *J Hematol Oncol* 5: 64 (2012) |
| monoclonal antibodies HB20-1-25, MB20-1-18 and derivatives such as, e.g., humanized variants and immunoglobulin-derived binding domains like scFvs | See e.g. WO2005000901 |
| obinutuzumab and derivatives such as, e.g., humanized variants and immunoglobulin-derived binding domains like scFvs | See e.g., Mössner E et al., *Blood* 115: 4393-402 (2010); Robak T, Robak E, *BioDrugs* 25: 13-25 (2011); Salles G et al., *Blood* 119: 5126-32 (2012); Golay J et al., *Blood* 122: 3482-91 (2013) |
| ocaratuzumab and derivatives such as, e.g., humanized variants and immunoglobulin-derived binding domains like scFvs | Cang S et al., *J Hematol Oncol* 5: 64 (2012) |
| ocrelizumab, PRO70769, and derivatives such as, e.g., humanized variants and immunoglobulin-derived binding domains like scFvs | See e.g. Morschhauser F et al., *Ann Oncol* 21: 1870-6 (2010); Cang S et al., *J Hematol Oncol* 5: 64 (2012) |
| ofatumumab and derivatives such as, e.g., immunoglobulin-derived binding domains like scFvs | See e.g. Hagenbeek A et al., *Blood* 111: 5486-95 (2008); Cang S et al., *J Hematol Oncol* 5: 64 (2012) |
| monoclonal antibodies OUBM1-OUBM8 | See e.g. Uchiyama S et al., *Cancer Sci* 101: 201-9 (2010) |
| monoclonal antibody PRO131921 and derivatives such as, e.g., humanized variants and immunoglobulin-derived binding domains like scFvs | See e.g. Robak T, Robak E, *BioDrugs* 25: 13-25 (2011); Cang S et al., *J Hematol Oncol* 5: 64 (2012) |
| rituximab and derivatives such as, e.g., humanized variants and iminunoglobulin-derived binding domains like scFvs | See e.g. Reff M et al., *Blood* 83: 435-45 (1994); Anderson D et al., *Biochem Soc Trans* 25: 705-8 (1997); Golay J et al., *Blood* 122: 3482-91 (2013); Kinder M |

TABLE 9-continued

Exemplary CD20 Binding Domains
Source of CD20 Binding Domain

| | |
|---|---|
| | et al., *J Biol Chem* 288: 3084-54 (2013); Zhang H et al., *Cell Physiol Biochem* 32: 645-54 (2013); Ahmadzadeh V et al., *Protein Expr Purif* 102: 45-41 (2014) |
| antibody TGLA and derivatives such as, e.g., humanized variants and immunoglobulin-derived binding domains like scFvs | See e.g. Lv M et al., *Cancer Lett* 294: 66-73 (2010) |
| tositumomab and derivatives such as, e.g., humanized variants and immunoglobulin-derived binding domains like scFvs | See e.g. Cheson B, *Curr Opin Investig Drugs* 3: 165-70 (2002) |
| TRU-015 and derivatives such as, e.g., humanized variants, scFv variants, and CDRs | See e.g. Burge D et al., *Clin Ther* 30: 1806-16 (2008); Robak T, Robak E, *BioDrugs* 25: 13-25 (2011)) |
| ublituximab and derivatives such as, e.g., humanized variants and immunoglobulin-derived binding domains like scFvs | See e.g. Abdelwahed R et al., *Invest Ophthalmol Vis Sci* 54: 3657-65 (2013); Garff-Tavernier M et al., *Leukemia* 28: 230-3 (2014) |
| veltuzumab, IMMU-106, hA20, and derivatives such as, e.g., humanized variants and immunoglobulin-derived binding domains like scFvs | See e.g. Morschhauser F et al., *J Clin Oncol* 27: 3346-53 (2009); Cang S et al., *J Hematol Oncol* 5: 64 (2012); Ellbrecht C et al., *JAMA Dermatol* 1939 (2014) |
| CD20 binding scFv(s) and derivatives such as, e.g, HL23, scFv-1, scFv-3, scFv-5, and scFv-8 | Sec e.g. Geng S et al., *Cell Mol Immunol* 3: 439-43 (2006); Olafesn T et al., *Protein Eng Des Sel* 23: 243-9 (2010); Fang H et al., *Sci China Life Sci* 54: 255-62 (2011) |
| various CD20 binding antibodies, antigen binding portions thereof, and derivatives such as, e.g., humanized variants and immunoglobulin-derived binding domains like scFvs | See e.g. Lim S et al., *Haematologica* 95: 135-43 (2010); U.S. Pat. No. 4,861,579; U.S. Pat. No. 5,500,362; U.S. Pat. No. 5,595,721; U.S. Pat. No. 5,677,180; U.S. Pat. No. 5,721,108; U.S. Pat. No. 5,736,137; U.S. Pat. No. 5,776,456; U.S. Pat. No. 5,843,398; U.S. Pat. No. 5,849,898; U.S. Pat. No. 6,015,542; U.S. Pat. No. 6,090,365; U.S. Pat. No. 6,120,767; U.S. Pat. No. 6,171,586; U.S. Pat. No. 6,194,551; U.S. Pat. No. 6,224,866; U.S. Pat. No. 6,242,195; U.S. Pat. No. 6,287,537; U.S. Pat. No. 6,306,393; U.S. Pat. No. 6,368,596; U.S. Pat. No. 6,399,061; U.S. Pat. No. 6,410,391; U.S. Pat. No. 6,455,043; U.S. Pat. No. 6,528,624; U.S. Pat. No. 6,538,124; U.S. Pat. No. 6,565,827; U.S. Pat. No. 6,652,852; U.S. Pat. No. 6,682,734; U.S. Pat. No. 7,879,984; U.S. Pat. No. 8,101,179; U.S. Pat. No. 8,153,125; U.S. Pat. No. 8,337,844; WO95/03770; WO98/58964; WO99/22764; WO00/09160; WO00/27428; WO00/27433; WO00/42072; WO00/44788; WO00/67795; WO00/67796; WO00/76542; WO01/03734; WO01/10460; WO01/10461; WO01/10462; WO01/13945; WO01/72333; WO01/80884; WO01/97858; WO02/060955; WO02/079255; WO02/096948; WO02/102312; WO03/002607; WO03/061694; WO2004/032828; WO2005/000901; WO2006/106959; WO2009031230; WO2014076292 |
| CD20 binding, fibronectin domain $FN3_{CD20}$ based on the fibronectin-derived $10^{th}$ fibronectin type III domain as an alternative scaffold to antibody binding domains | See e.g. Natarajan A et al., *Clin Cancer Res* 19: 6820-9 (2013); |
| monoclonal antibodies which bind to various mammalian CD20 antigens | U.S. 2011/0091483; U.S. 12/0941,583; PCT/US2010/055826; EP20140151932; PCT/GB2012/052532; U.S. 13/048,135; EP20140151932; PCT/GB2012/052532; U.S. 13/048,135; PCT/US2006/046034 |

TABLE 9-continued

| Exemplary CD20 Binding Domains Source of CD20 Binding Domain | |
|---|---|
| nucleic acids which can be used to generate anti-CD20 antibodies; antigen binding fragments, and derivatives thereof | U.S. Pat. No. 8,097,713; U.S. 12/0965956 |

While some embodiments of the invention have been described by way of illustration, it will be apparent that the invention may be put into practice with many modifications, variations and adaptations, and with the use of numerous equivalents or alternative solutions that are within the scope of persons skilled in the art, without departing from the spirit of the invention or exceeding the scope of the claims.

All publications, patents, and patent applications are herein incorporated by reference in their entirety to the same extent as if each individual publication, patent or patent application was specifically and individually indicated to be incorporated by reference in its entirety. The patent application publications WO 2005/092917. WO 2007/033497, US 2013/196928, WO 2014/164680. WO 2014/164693, WO 2015/113005, WO 2015/113007, WO 2015/138435, WO 2015/138452, US 2015/0259428, and WO 2015/191764 are each incorporated herein by reference in its entirety. The disclosures of U.S. patent application serial number U.S. Ser. No. 14/965,882 is incorporated herein by reference in its entirety. The disclosures of U.S. provisional patent applications 61/777,130, 62/112,314, and 62/249,193 are each incorporated herein by reference in its entirety. The complete disclosures of all electronically available biological sequence information from GenBank (National Center for Biotechnology Information, U.S.) for amino acid and nucleotide sequences cited herein are each incorporated herein by reference in its entirety.

Sequence Listing

| ID Number | Text Description | Biological Sequence |
|---|---|---|
| SEQ ID NO: 1 | Shiga-like toxin 1 Subunit A (SLT-1A) | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVAR<br>MASDEFPSMCPADGRVRGITHNKILWDSSTLGAILM<br>RRTISS |
| SEQ ID NO: 2 | Shiga toxin Subunit A (StxA) | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVAR<br>MASDEFPSMCPADGRVRGITHNKILWDSSTLGAILM<br>RRTISS |
| SEQ ID NO: 3 | Shiga-like toxin 2 Subunit A (SLT-2A) | DEFTVDFSSQKSYVDSLNSIRSAISTPLGNISQGGVS<br>VSVINHVLGGNYISLNVRGLDPYSERFNHLRLIMER<br>NNLYVAGFINTETNIFYRFSDFSHISVPDVITVSMTT<br>DSSYSSLQRIADLERTGMQIGRHSLVGSYLDLMEFR<br>GRSMTRASSRAMLRFVTVIAEALRFRQIQRGFRPAL<br>SEASPLYTMTAQDVDLTLNWGRISNVLPEYRGEEG<br>VRIGRISFNSLSAILGSVAVILNCHSTGSYSVRSVSQK<br>QKTECQIVGDRAAIKVNNVLWEANTIAALLNRKPQ<br>DLTEPNQ |
| SEQ ID NO: 4 | Shiga toxin effector region SLT-1A | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVAR |
| SEQ ID NO: 5 | heavy chain CDR1 | GYTFTSYNMH |
| SEQ ID NO: 6 | heavy chain CDR2 | AIYPGNGDTSYNQKFKG |
| SEQ ID NO: 7 | heavy chain CDR3 | AQLRPNYWYFDV |
| SEQ ID NO: 8 | light chain CDR1 | RASSSVSYMH |

-continued

| ID Number | Text Description | Biological Sequence |
|---|---|---|
| SEQ ID NO: 9 | light chain CDR2 | ATSNLAS |
| SEQ ID NO: 10 | light chain CDR3 | QQWTSNPPT |
| SEQ ID NO: 11 | heavy chain CDR1 | GYTFTSYNVH |
| SEQ ID NO: 12 | heavy chain CDR2 | AIYGNGDTSFNQKFKG |
| SEQ ID NO: 13 | heavy chain CDR3 | SNYYGSSYWFFDV |
| SEQ ID NO: 14 | light chain CDR1 | RASSSVSYMD |
| SEQ ID NO: 15 | light chain CDR2 | ATSNLAS |
| SEQ ID NO: 16 | light chain CDR3 | QQWTSNPPT |
| SEQ ID NO: 17 | heavy chain CDR1 | GYTFTSYNMH |
| SEQ ID NO: 18 | heavy chain CDR2 | AIYPGNGDTSYNQKFKG |
| SEQ ID NO: 19 | heavy chain CDR3 | STYYGGDWYFNV |
| SEQ ID NO: 20 | light chain CDR1 | RASSSVSYIH |
| SEQ ID NO: 21 | light chain CDR2 | ATSNLAS |
| SEQ ID NO: 22 | light chain CDR3 | QQWTSNPPT |
| SEQ ID NO: 23 | heavy chain CDR1 | GFTFNDYAMH |
| SEQ ID NO: 24 | heavy chain CDR2 | TISWNSGSIGYADSVKG |
| SEQ ID NO: 25 | heavy chain CDR3 | DIQYGNYYYGMDV |
| SEQ ID NO: 26 | light chain CDR1 | RASQSVSSYLA |
| SEQ ID NO: 27 | light chain CDR2 | DASNRAT |
| SEQ ID NO: 28 | light chin CDR3 | QQRSNWPIT |
| SEQ ID NO: 29 | heavy chain CDR1 | GYTFTSYNMH |
| SEQ ID NO: 30 | heavy chain CDR2 | AIYPGNGDTSYNQKFKG |
| SEQ ID NO: 31 | heavy chain CDR3 | VVYYSNSYWYFDV |
| SEQ ID NO: 32 | light chain CDR1 | RASSSVSYMH |
| SEQ ID NO: 33 | light chain CDR2 | APSNLAS |
| SEQ ID NO: 34 | light chain CDR3 | QQWSFNPPT |
| SEQ ID NO: 35 | heavy chain CDR1 | GYAFSYSWIN |
| SEQ ID NO: 36 | heavy chain CDR2 | RIFPGDGDTDYNGKFKG |
| SEQ ID NO: 37 | heavy chain CDR3 | NVFDGYWLVY |
| SEQ ID NO: 38 | light chain CDR1 | RSSKSLLHSNGITYLY |

| | | Sequence Listing |
|---|---|---|
| ID Number | Text Description | Biological Sequence |
| SEQ ID NO: 39 | light chain CDR2 | QMSNLVS |
| SEQ ID NO: 40 | light chain CDR3 | AQNLELPYT |
| SEQ ID NO: 41 | linker 1 | EFPKPSTPPGSSGGAP |
| SEQ ID NO: 42 | linker 2 | GGGGSGG |
| SEQ ID NO: 43 | linker 3 | GGGGSGGGGSGGGGSGGGGSGGGGS |
| SEQ ID NO: 44 | linker 4 | GSTSGSGKPGSGEGS |
| SEQ ID NO: 45 | linker 5 | GGGGS |
| SEQ ID NO: 46 | linker extension | GILGFVFTL |
| SEQ ID NO: 47 | multivalent CD20-binding molecule component 1 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARAQLRP NYWYFDVWGAGTTVTVSSGGGGSGGGGSGGGGS GGGGSGGGGSDIVLSQSPAILSASPGEKVTMTCRAS SSVSYMHWYQQKPGSSPKPWIYATSNLASGVPARF SGSGSGTSYSLTISRVEAEDAATYYCQQWTSNPPTF GAGTKLELKEFPKPSTPPGSSGGAPKEFTLDFSTAKT YVDSLNVIRSAIGTPLQTISSGGTSLLMIDSGSGDNL FAVDVRGIDPEEGRFNNLRLIVERNNLYVTGFVNRT NNVFYRFADFSHVTFPGTTAVTLSGDSSYTTLQRVA GISRTGMQINRHSLTTSYLDLMSHSGTSLTQSVARA MLRFVTVTAEALRFRQIQRGFRTTLDDLSGRSYVM TAEDVDLTLNWGRLSSVLPDYHGQDSVRVGRISFG SINAILGSVALILNSHHASRVARKDEL |
| SEQ ID NO: 48 | multivalent CD20-binding molecule component 2 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARAQLRP NYWYFDVWGAGTTVTVSSGSTSGSGKPGSGEGSDI VLSQSPAILSASPGEKVTMTCRASSSVSYMHWYQQ KPGSSPKPWIYATSNLASGVPARFSGSGSGTSYSLTI SRVEAEDAATYYCQQWTSNPPTFGAGTKLELKEFPK PSTPPGSSGGAPKEFTLDFSTAKTYVDSLNVIRSAIG TPLQTISSGGTSLLMIDSGSGDNLFAVDVRGIDPEEG RFNNLRLIVERNNLYVTGFVNRTNNVFYRFADFSH VTFPGTTAVTLSGDSSYTTLQRVAGISRTGMQINRH SLTTSYLDLMSHSGTSLTQSVARAMLRFVTVTAEA LRFRQIQRGFRTTLDDLSGRSYVMTAEDVDLTLNW GRLSSVLPDYHGQDSVRVGRISFGSINAILGSVALIL NSHHASRVAR |
| SEQ ID NO: 49 | multivalent CD20-binding molecule component 3 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARAQLRP NYWYFDVWGAGTTVTVSSGGGGSDIVLSQSPAILS ASPGEKVTMTCRASSSVSYMHWYQQKPGSSPKPWI YATSNLASGVPARFSGSGSGTSYSLTISRVEAEDAA TYYCQQWTSNPPTFGAGTKLELKEFPKPSTPPGSSG GAPKEFTLDFSTAKTYVDSLNVIRSAIGTPLQTISSG GTSLLMIDSGSGDNLFAVDVRGIAPEEGRFNNLRLI VERNNLYVTGFVNRTNNVFYRFADFSHVTFPGTTA VTLSGDSSYTTLQRVAGISRTGMQINRHSLTTSYLD LMSHSGTSLTQSVARAMLRFVTVTAEALRFRQIQR GFRTTLDDLSGRSYVMTAEDVDLTLNWGRLSSVLP DYHGQDSVRVGRISFGSINAILGSVALILNSHHAS RVAR |
| SEQ ID NO: 50 | multivalent CD20-binding molecule component 4 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARAQLRP |

| ID Number | Text Description | Biological Sequence |
|---|---|---|
| | | NYWYFDVWGAGTTVTVSSGGGGSGGGGSGGGGS GGGGSGGGGSDIVLSQSPAILSASPGEKVTMTCRAS SSVSYMHWYQQKPGSSPKPWIYATSNLASGVPARF SGSGSGTSYSLTISRVEAEDAATYYCQQWTSNPPTF GAGTKLELKGGGGSGGKEFTLDFSTAKTYVDSLNV IRSAIGTPLQTISSGGTSLLMIDSGSGDNLFAVDVRGI APEEGRFNNLRLIVERNNLYVTGFVNRTNNVFYRF ADFSHVTFPGTTAVTLSGDSSYTTLQRVAGISRTGM QINRHSLTTSYLDLMSHSGTSLTQSVARAMLRFVTV TAEALRFRQIQRGFRTTLDDLSGRSYVMTAEDVDL TLNWGRLSSVLPDYHGQDSVRVGRISFGSINAILGS VALILNSHHHASRVAR |
| SEQ ID NO: 51 | multivalent CD20-binding molecule component 5 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARAQLRP NYWYFDVWGAGTTVTVSSGSTSGSGKPGSGEGSDI VLSQSPAILSASPGEKVTMTCRASSSVSYMHWYQQ KPGSSPKPWPIYATSNLASGVPARFSGSGSGTSYSLTI SRVEAEDAATYYCQQWNSNPPTFGAGTKLELKGGG GSGGKEFTLDFSTAKTYVDSLNVIRSAIGTPLQTISS GGTSLLMIDNLVPMVATVVDVRGIDPEEGRFNNLR LIVERNNLYVTGFVNRTNNVFYRFADFSHVTFPGTT AVTLSGDSSYTTLQRVAGISRTGMQINRHSLTTSYL DLMSHSGTSLTQSVARAMLRFVTVTAEALRFRQIQ RGFRTTLDDLSGRSYVMTAEDVDLTLNWGRLSSVL PDYHGQDSVRVGRISFGSINAILGSVALILNSHHHAS RVAR |
| SEQ ID NO: 52 | multivalent CD20-binding molecule component 6 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARAQLRP NYWYFDVWGAGTTVTVSSGGGGSDIVLSQSPAILS ASPGEKVTMTCRASSSVSYMHWYQQKPGSSPKPWI YATSNLASGVPARFSGSGSGTSYSLTISRVEAEDAA TYYCQQWTSNPPTFGAGTKLELKEFPKPSTPPGSSG GAPGILGFVFTLKEFTLDFSTAKTYVDSLNVIRSAIG TPLQTISSGGTSLLMIDSGSGDNLFAVDVRGIDPEEG RFNNLRLIVERNNLYVTGFVNRTNNVFYRFADFSH VTFPGTTAVTLSGDSSYTTLQRVAGISRTGMQINRH SLTTSYLDLMSHSGTSLTQSVARAMLRFVTVTAEA LRFRQIQRGFRTTLDDLSGRSYVMTAEDVDLTLNW GRLSSVLPDYHGQDSVRVGRISFGSINAILGSVALIL NSHHHASAVAA |
| SEQ ID NO: 53 | multivalent CD20-binding molecule component 7 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGGGGSGGGGSGGGGSG GGGSGGGGSQIVLSQSPTILSASPGEKVTMTCRASSS VSYMDWYQQKPGSSPKPWIYATSNLASGVPARFSG SGSGTSYSLTISRVEAEDAATYYCQQWTSNPPTFGA GTKLELKEFPKPSTPPGSSGGAPKEFTLDFSTAKTYV DSLNVIRSAIGTPLQTISSGGTSLLMIDSGSGDNLFA VDVRGIDPEEGRFNNLRLIVERNNLYVFGFVNRTNN VFYRFADFSHVTFPGTTAVTLSGDSSYTTLQRVAGI SRTGMQINRHSLTTSYLDLMSHSGTSLTQSVARAM LRFVTVTAEALRFRQIQRGFRTTLDDLSGRSYVMTA EDVDLTLNWGRLSSVLPDYHGQDSVRVGRISFGSIN AILGSVALILNSHHHASRVAR |
| SEQ ID NO: 54 | multivalent CD20-binding molecule component 8 | MQVQLQQPGAELVKPGASVKMSCKTSGYTFTSYN VHWVKQTPGQGLEWIGAIYPGNGDTSFNQKFKGK ATLTADKSSSTVYMQLSSLTSEDSAVYYCARSNYY GSSYVWFFDVWGAGTTVTVSSGSTSGSGKPGSGEG SQIVLSQSPTILSASPGEKVTMTCRASSSVSYMDWY QQKPGSSPKPWIYATSNLASGVPARFSGSGSGTSYS LTISRVEAEDAATYYCQQWTSNPPTFGAGTKLELKE FPKPSTPPGSSGGAPKEFTLDFSTAKTYVDSLNVIRS AIGTPLQTISSGGTSLLMIDSGSGDNLFAVDVRGIDP EEGRFNNLRLIVERNNLYVFGFVNRTNNVFYRFAD FSHVTFPGTTAVTLSGDSSYTTLQRVAGISRTGMQI NRHSLTTSYLDLMSHSGTSLTQSVARAMLRFVTVT |

| ID Number | Text Description | Biological Sequence |
|---|---|---|
| | | AEALRFRQIQRGFRTTLDDLSGRSYVMTAEDVDLTL NWGRLSSVLPDYHGQDSVRVGRISFGSINAILGSV ALILNSHHHASRVAR |
| SEQ ID NO: 55 | multivalent CD20-binding molecule component 9 | QVQLVQSGAELVKPGASVKMSCKASGYTFTSYNVH WVKQTPGQGLEWIGAIYPGNGDTSYNQKFKGKATL TADKSSSTAYMQLSSLTSEDSAVYYCARSNYYGSS YVWFFDVWGAGTTVTVSSGSTSGSGKPGSGEGSQI VLSQSPTILSASPGEKVTMTCRASSSVSYMHWYQQ KPGSSPKPWIYATSNLASGVPARFSGSGSGTSYSLTI SRVEAEDAATYYCQQWTSNPPTFGAGTKLELKEFPK PSTPPGSSGGAPKEFTLDFSTAKTYVDSLNVIRSAIG TPLQTISSGGTSLLMIDSGSGDNLFAVDVRGIDPEEG RFNNLRLIVERNNLYVTGFVNRTNNVFYRFADFSH VTFPGTTAVTLSGDSSYTTLQRVAGISRTGMQINRH SLTTSYLDLMSHSGTSLTQSVARAMLRFVTVTAEA LRFRQIQRGFRTTLDDLSGRSYVMTAEDVDLTLNW GRLSSVLPDYHGQDSVRVGRISFGSINAILGSVALIL NSHHHASAVAR |
| SEQ ID NO: 56 | multivalent CD20-binding molecule component 10 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGGGGSQIVLSQSPTILSA SPGEKVTMTCRASSSVSYMDWYQQKPGSSPKPWIY ATSNLASGVPARFSGSGSGTSYSLTISRVEAEDAAT YYCQQWTSNPPTFGAGTKLELKEFPKPSTPPGSSGG APKEFTLDFSTAKTYVDSLNVIRSAIGTPLQTISSGG TSLLMIDSGSGDNLFAVDVRGIDPEEGRFNNLRLIVE RNNLYVFGFVNRTNNVFYRFADFSHVTFPGTTAVT LSGDSSYTTLQRVAGISRTGMQINRHSLTTSYLDLM SHSGTSLTQSVARAMLRFVTVTAEALRFRQIQRGFR TTLDDLSGRSYVMTAEDVDLTLNWGRLSSVLPDYH GQDSVRVGRISFGSINAILGSVALILNSHHHASRVAR |
| SEQ ID NO: 57 | multivalent CD20-binding molecule component 11 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGGGGSGGGGSGGGGSG GGGSGGGGSQIVLSQSPTILSASPGEKVTMTCRASSS VSYMDWYQQKPGSSPKPWIYATSNLASGVPARFSG SGSGTSYSLTISRVEAEDAATYYCQQWTSNPPTFGA GTKLELKGGGGSGGKEFTLDFSTAKTYVDSLNVIRS AIGTPLQTISSGGTSLLMIDSGSGDNLFAVDVRGIDP EEGRFNNLRLIVERNNLYVFGFVNRTNNVFYRFAD FSHVTFPGTTAVTLSGDSSYTTLQRVAGISRTGMQI NRHSLTTSYLDLMSHSGTSLTQSVARAMLRFVTVT AEALRFRQIQRGFRTTLDDLSGRSYVMTAEDVDLT LNWGRLSSVLPDYHGQDSVRVGRISFGSINAILGSV ALILNSHHHASRVAR |
| SEQ ID NO: 58 | multivalent CD20-binding molecule component 12 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGSTSGSGKPGSGEGSQI VLSQSPTILSASPGEKVTMTCRASSSVSYMDWYQQ KPGSSPKPWIYATSNLASGVPARFSGSGSGTSYSLTI SRVEAEDAATYYCQQWTSNPPTFGAGTKLELKGGG GSGGKEFTLDFSTAKTYVDSLNVIRSAIGTPLQTISS GGTSLLMIDSGSGDNLFAVDVRGIDPEEGRFNNLRL IVERNNLYVFGFVNRTNNVFYRFADFSHVTFPGTTA VTLSGDSSYTTLQRVAGISRTGMQINRHSLTTSYLD LMSHSGTSLTQSVARAMLRFVTVTAEALRFRQIQR GFRTTLDDLSGRSYVMTAEDVDLTLNWGRLSSVLP DYHGQDSVRVGRISFGSINAILGSVALILNSHHHAS RVARRVAR |
| SEQ ID NO: 59 | multivalent CD20-binding molecule component 13 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGGGGSGGGGSGGGGSG GGGSGGGGSQIVLSQSPTILSASPGEKVTMTCRASSS VSYMDWYQQKPGSSPKPWIYATSNLASGVPARFSG SGSGTSYSLTISRVEAEDAATYYCQQWTSNPPTFGA GTKLELKEFPKPSTPPGSSGGAPGILGFVFTLKEFTL |

| ID Number | Text Description | Biological Sequence |
|---|---|---|
| | | DFSTAKTYVDSLNVIRSAIGTPLQTISSGGTSLLMIDS<br>GSGDNLFAVDVRGIDPEEGRFNNLRLIVERNNLYVT<br>GFVNRTNNVFYRFADFSHVTFPGTTAVTLSGDSSYT<br>TLQRVAGISRTGMQINRHSLTTSYLDLMSHSGTSLT<br>QSVARAMLRFVTVTAEALRFRQIQRGFRTTLDDLS<br>GRSYVMTAEDVDLTLNWGRLSSVLPDYHGQDSVR<br>VGRISFGSINAILGSVALILNSHHHASRVAR |
| SEQ ID<br>NO: 60 | multivalent CD20-<br>binding molecule<br>component 14 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGSTSGSGKPGSGEGSQI<br>VLSQSPTILSASPGEKVTMTCRASSSVSYMDWYQQ<br>KPGSSPKPWIYATSNLASGVPARFSGSGSGTSYSLTI<br>SRVEAEDAATYYCQQWTSNPPTFGAGTKLELKEFPK<br>PSTPPGSSGGAPGILGFVFTLKEFTLDFSTAKTYVDS<br>LNVIRSAIGTPLQTISSGGTSLLMIDSGSGDNLFAVD<br>VRGIDPEEGRFNNLRLIVERNNLYVFGFVNRTNNVF<br>YRFADFSHVTFPGTTAVTLSGDSSYTTLQRVAGISR<br>TGMQINRHSLTTSYLDLMSHSGTSLTQSVARAMLR<br>FVTVTAEALRFRQIQRGFRTTLDDLSGRSYVMTAED<br>VDLTLNWGRLSSVLPDYHGQDSVRVGRISFGSINAI<br>LGSVALILNSHHHASRVAR |
| SEQ ID<br>NO: 61 | multivalent CD20-<br>binding molecule<br>component 15 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGGGGSQIVLSQSPTILSA<br>SPGEKVTMTCRASSSVSYMDWYQQKPGSSPKPWIY<br>ATSNLASGVPARFSGSGSGTSYSLTISRVEAEDAAT<br>YYCQQWTSNPPTFGAGTKLELKEFPKPSTPPGSSGG<br>APGILGFVFTLKEFTLDFSTAKTYVDSLNVIRSAIGT<br>PLQTISSGGTSLLMIDSGSGDNLFAVDVRGIDPEEGR<br>FNNLRLIVERNNLYVFGFVNRTNNVFYRFADFSHV<br>TFPGTTAVTLSGDSSYTTLQRVAGISRTGMQINRHS<br>LTTSYLDLMSHSGTSLTQSVARAMLRFVTVTAEAL<br>RFRQIQRGFRTTLDDLSGRSYVMTAEDVDLTLNWG<br>RLSSVLPDYHGQDSVRVGRISFGSINAILGSVALILN<br>CHHHASRVAR |
| SEQ ID<br>NO: 62 | multivalent CD20-<br>binding molecule<br>component 16 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGGGGSQIVLSQSPTILSA<br>SPGEKVTMTCRASSSVSYMDWYQQKPGSSPKPWIY<br>ATSNLASGVPARFSGSGSGTSYSLTISRVEAEDAAT<br>YYCQQWTSNPPTFGAGTKLELKGGGGSGGKEFTLD<br>FSTAKTYVDSLNVIRSAIGTPLQTISSGGTSLLMIDSG<br>TGDNLFAVDVRGIDPEEGRFNNLRLIVERNNLYVTG<br>FVNRTNNVFYRFADFSHVTFPGTTAVTLSGDSSYTT<br>LQRVAGISRTGMQINRHSLTTSYLDLMSHSGTSLTQ<br>SVARAMLRFVTVTAEALRFRQIQRGFRTTLDDLSGR<br>SYVMTAEDVDLTLNWGRLSSVLPDYHGQDSVRVG<br>RISFGSINAILGSVALILNSHHHASRVAR |
| SEQ ID<br>NO: 63 | multivalent CD20-<br>binding molecule<br>component 17 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGGGGSGGGGSGGGGSG<br>GGSGGGGSQIVLSQSPTILSASPGEKVTMTCRASSS<br>VSYMDWYQQKPGSSPKPWIYATSNLASGVPARFSG<br>SGSGTSYSLTISRVEAEDAATYYCQQWTSNPPTFGA<br>GTKLELKEFPKPSTPPGSSGGAPKEFTLDFSTAKTYV<br>DSLNVIRSAIGTPLQTISSGGTSLLMIDSGSGDNLFA<br>VDVRGIAPEEGRFNNLRLIVERNNLYVTGFVNRTNN<br>VFYRFADFSHVTFPGTTAVTLSGDSSYTTLQRVAGI<br>SRTGMQINRHSLTTSYLDLMSHSGTSLTQSVARAM<br>LRFVTVTAEALRFRQIQRGFRTTLDDLSGRSYVMTA<br>EDVDLTLNWGRLSSVLPDYHGQDSVRVGRISFGSIN<br>AILGSVALILNSHHHAS |
| SEQ ID<br>NO: 64 | multivalent CD20-<br>binding molecule<br>component 18 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGSTSGSGKPGSGEGSQI |

| Sequence Listing | | |
|---|---|---|
| ID Number | Text Description | Biological Sequence |
| | | VLSQSPTILSASPGEKVTMTCRASSSVSYMDWYQQ<br>KPGSSPKPWIYATSNLASGVPARFSGSGSGTSYSLTI<br>SRVEAEDAATYYCQQWTSNPPTFGAGTKLELKEFPK<br>PSTPPGSSGGAPKEFTLDFSTAKTYVDSLNVIRSAIG<br>TPLQTISSGGTSLLMIDSGSGDNLFAVDVRGIDPEE<br>GRFNNLRLIVERNNLYVFGFVNRTNNVFYRFADFS<br>HVTFPGTTAVTLSGDSSYTTLQRVAGISRTGMQINR<br>HSLTTSYLDLMSHSGTSLTQSVARAMLRFVTVTAE<br>ALRFRQIQRGFRTTLDDLSGRSYVMTAEDVDLTLN<br>WGRLSSVLPDYHGQDSVRVGRISFGSINAILGSVALI<br>LNSHHHASRVAR |
| SEQ ID<br>NO: 65 | multivalent CD20-<br>binding molecule<br>component 19 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGGGGSGGGGSGGGGSG<br>GGGSGGGGSQIVLSQSPTILSASPGEKVTMTCRASSS<br>VSYMDWYQQKPGSSPKPWIYATSNLASGVPARFSG<br>SGSGTSYSLTISRVEAEDAATYYCQQWTSNPPTFGA<br>GTKLELKEFPKPSTPPGSSGGAPGILGFVFTLKEFTL<br>DFSTAKTYVDSLNVIRSAIGTPLQTISSGGTSLLMIDS<br>GSGDNLFAVDVRGIDPEEGRFNNLRLIVERNNLYVT<br>GFVNRTNNVFYRFADFSHVTFPGTTAVTLSGDSSYT<br>TLQRVAGISRTGMQINRHSLTTSYLDLMSHSGTSLT<br>QSVARAMLRFVTVTAEALRFRQIQRGFRTTLDDLS<br>GRSYVMTAEDVDLTLNWGRLSSVLPDYHGQDSVR<br>VGRISFGSINAILGSVALILNSHHHAS |
| SEQ ID<br>NO: 66 | multivalent CD20-<br>binding molecule<br>component 20 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGGGGSGGGGSGGGGSG<br>GGGSGGGGSQIVLSQSPTILSASPGEKVTMTCRASSS<br>VSYMDWYQQKPGSSPKPWIYATSNLASGVPARFSG<br>SGSGTSYSLTISRVEAEDAATYYCQQWTSNPPTFGA<br>GTKLELKEFPKPSTPPGSSGGAPKEFTLDFSTAKTYV<br>DSLNVIRSAIGTPLQTISSGGTSLLMIDSGSGDNLFA<br>VDVRGIDPEEGRFNNLRLIVERNNLYVTGFVNRTNN<br>VFYRFADFSHVTFPGTTAVTLSGDSSYTTLQRVAGI<br>SRTGMQINRHSLTTSYLDLMSHSGTSLTQSVARAM<br>LRFVTVTAEALRFRQIQRGFRTTLDDLSGRSYVMTA<br>EDVDLTLNWGRLSSVLPDYHGQDSVRVGRISFGSIN<br>AILGSVALILNSHHHASRVARKDEL |
| SEQ ID<br>NO: 67 | multivalent CD20-<br>binding molecule<br>component 21 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGSTSGSGKPGSGEGSQI<br>VLSQSPTILSASPGEKVTMTCRASSSVSYMDWYQQ<br>KPGSSPKPWIYATSNLASGVPARFSGSGSGTSYSLTI<br>SRVEAEDAATYYCQQWTSNPPTFGAGTKLELKEFPK<br>PSTPPGSSGGAPKEFTLDFSTAKTYVDSLNVIRSAIG<br>TPLQTISSGGTSLLMIDSGSGDNLFAVDVRGIDPEEG<br>RFNNLRLIVERNNLYVFGFVNRTNNVFYRFADFSH<br>VTFPGTTAVTLSGDSSYTTLQRVAGISRTGMQINRH<br>SLTTSYLDLMSHSGTSLTQSVARAMLRFVTVTAEA<br>LRFRQIQRGFRTTLDDLSGRSYVMTAEDVDLTLNW<br>GRLSSVLPDYHGQDSVRVGRISFGSINAILGSVALIL<br>NSHHHASRVARKDEL |
| SEQ ID<br>NO: 68 | multivalent CD20-<br>binding molecule<br>component 22 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGGGGSQIVLSQSPTILSA<br>SPGEKVTMTCRASSSVSYMDWYQQKPGSSPKPWIY<br>ATSNLASGVPARFSGSGSGTSYSLTISRVEAEDAAT<br>YYCQQWTSNPPTFGAGTKLELKEFPKPSTPPGSSGG<br>APKEFTLDFSTAKTYVDSLNVIRSAIGTPLQTISSGG<br>TSLLMIDSGTGDNLFAVDVRGIDPEEGRFNNLRLIVE<br>RNNLYVTGFVNRTNNVFYRFADFSHVTFPGTTAVT<br>LSGDSSYTTLQRVAGISRTGMQINRHSLTTSYLDLM<br>SHSGTSLTQSVARAMLRFVTVTAEALRFRQIQRGFR<br>TTLDDLSGRSYVMTAEDVDLTLNWGRLSSVLPDYH<br>GQDSVRVGRISFGSINAILGSVALILNSHHHASRVAR<br>KDEL |

Sequence Listing

| ID Number | Text Description | Biological Sequence |
|---|---|---|
| SEQ ID NO: 69 | multivalent CD20-binding molecule component 23 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGGGGSGGGGSGGGGSG GGGSGGGGSQIVLSQSPTILSASPGEKVTMTCRASSS VSYMDWYQQKPGSSPKPWIYATSNLASGVPARFSG SGSGTSYSLTISRVEAEDAATYYCQQWTSNPPTFGA GTKLELKGGGGSGGKEFTLDFSTAKTYVDSLNVIRS AIGTPLQTISSGGTSLLMIDSGSGDNLFAVDVRGIDP EEGRFNNLRLIVERNNLYVTGFVNRTNNVFYRFAD FSHVTFPGTTAVTLSGDSSYTTLQRVAGISRTGMQI NRHSLTTSYLDLMSHSGTSLTQSVARAMLRFVTVT AEALRFRQIQRGFRTTLDDLSGRSYVMTAEDVDLT LNWGRLSSVLPDYHGQDSVRVGRISFGSINAILGSV ALILNSHHHASRVARKDEL |
| SEQ ID NO: 70 | multivalent CD20-binding molecule component 24 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGSTSGSGKPGSGEGSQI VLSQSPTILSASPGEKVTMTCRASSSVSYMDWYQQ KPGSSPKPWIYATSNLASGVPARFSGSGSGTSYSLTI SRVEAEDAATYYCQQWTSNPPTFGAGTKLELKGGG GSGGKEFTLDFSTAKTYVDSLNVIRSAIGTPLQTISS GGTSLLMIDSGSGDNLFAVDVRGIDPEEGRFNNLRL IVERNNLYVFGFVNRTNNVFYRFADFSHVTFPGTTA VTLSGDSSYTTLQRVAGISRTGMQINRHSLTTSYLD LMSHSGTSLTQSVARAMLRFVTVTAEALRFRQIQR GFRTTLDDLSGRSYVMTAEDVDLTLNWGRLSSVLP DYHGQDSVRVGRISFGSINAILGSVALILNSHHHAS RVARKDEL |
| SEQ ID NO: 71 | multivalent CD20-binding molecule component 25 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGGGGSGGGGSGGGGSG GGGSGGGGSQIVLSQSPTILSASPGEKVTMTCRASSS VSYMDWYQQKPGSSPKPWIYATSNLASGVPARFSG SGSGTSYSLTISRVEAEDAATYYCQQWTSNPPTFGA GTKLELKEFPKPSTPPGSSGGAPGILGFVFTLKEFTL DFSTAKTYVDSLNVIRSAIGTPLQTISSGGTSLLMIDS GSGDNLFAVDVRGIDPEEGRFNNLRLIVERNNLYVT GFVNRTNNVFYRFADFSHVTFPGTTAVTLSGDSSYT TLQRVAGISRTGMQINRHSLTTSYLDLMSHSGTSLT QSVARAMLRFVTVTAEALRFRQIQRGFRTTLDDLS GRSYVMTAEDVDLTLNWGRLSSVLPDYHGQDSVR VGRISFGSINAILGSVALILNSHHHASRVARKDEL |
| SEQ ID NO: 72 | multivalent CD20-binding molecule component 26 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGSTSGSGKPGSGEGSQI VLSQSPTILSASPGEKVTMTCRASSSVSYMDWYQQ KPGSSPKPWIYATSNLASGVPARFSGSGSGTSYSLTI SRVEAEDAATYYCQQWTSNPPTFGAGTKLELKEFPK PSTPPGSSGGAPGILGFVFTLKEFTLDFSTAKTYVDS LNVIRSAIGTPLQTISSGGTSLLMIDSGSGDNLFAVD VRGIDPEEGRFNNLRLIVERNNLYVFGFVNRTNNVF YRFADFSHVTFPGTTAVTLSGDSSYTTLQRVAGISR TGMQINRHSLTTSYLDLMSHSGTSLTQSVARAMLR FVTVTAEALRFRQIQRGFRTTLDDLSGRSYVMTAED VDLTLNWGRLSSVLPDYHGQDSVRVGRISFGSINAI LGSVALILNSHHHASRVARKDEL |
| SEQ ID NO: 73 | multivalent CD20-binding molecule component 27 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGGGGSQIVLSQSPTILSA SPGEKVTMTCRASSSVSYMDWYQQKPGSSPKPWIY ATSNLASGVPARFSGSGSGTSYSLTISRVEAEDAAT YYCQQWTSNPPTFGAGTKLELKEFPKPSTPPGSSGG APGILGFVFTLKEFTLDFSTAKTYVDSLNVIRSAIGT PLQTISSGGTSLLMIDSGTGDNLFAVDVRGIDPEEGR FNNLRLIVERNNLYVTGFVNRTNNVFYRFADFSHV |

-continued

| Sequence Listing | | |
|---|---|---|
| ID Number | Text Description | Biological Sequence |
| | | TFPGTTAVTLSGDSSYTTLQRVAGISRTGMQINRHS<br>LTTSYLDLMSHSGTSLTQSVARAMLRFVTVTAEAL<br>RFRQIQRGFRTTLDDLSGRSYVMTAEDVDLTLNWG<br>RLSSVLPDYHGQDSVRVGRISFGSINAILGSVALILN<br>CHHHASRVARKDEL |
| SEQ ID<br>NO: 74 | multivalent CD20-<br>binding molecule<br>component 28 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGGGGSQIVLSQSPTILSA<br>SPGEKVTMTCRASSSVSYMDWYQQKPGSSPKWIY<br>ATSNLASGVPARFSGSGSGTSYSLTISRVEAEDAAT<br>YYCQQWTSNPPTFGAGTKLELKGGGGSGGKEFTLD<br>FSTAKTYVDSLNVIRSAIGTPLQTISSGGTSLLMIDSG<br>TGDNLFAVDVRGIDPEEGRFNNLRLIVERNNLYVTG<br>FVNRTNNVFYRFADFSHVTFPGTTAVTLSGDSSYTT<br>LQRVAGISRTGMQINRHSLTTSYLDLMSHSGTSLTQ<br>SVARAMLRFVTVTAEALRFRQIQRGFRTTLDDLSGR<br>SYVMTAEDVDLTLNWGRLSSVLPDYHGQDSVRVG<br>RISFGSINAILGSVALILNSHHHASRVARKDEL |
| SEQ ID<br>NO: 75 | multivalent CD20-<br>binding molecule<br>component 29 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGGGGSGGGGSGGGGSG<br>GGGSGGGGSQIVLSQSPTILSASPGEKVTMTCRASSS<br>VSYMDWYQQKPGSSPKWIYATSNLASGVPARFSG<br>SGSGTSYSLTISRVEAEDAATYYCQQWTSNPPTFGA<br>GTKLELKEFPKSTPPGSSGGAPKEFTLDFSTAKTYV<br>DSLNVIRSAIGTPLQTISSGGTSLLMIDSGSGDNLFA<br>VDVRGIDPEEGRFNNLRLIVERNNLYVTGFVNRTNN<br>VFYRFADFSHVTFPGTTAVTLSGDSSYTTLQRVAGI<br>SRTGMQINRHSLTTSYLDLMSHSGTSLTQSVARAM<br>LRFVTVTAEALRFRQIQRGFRTTLDDLSGRSYVMTA<br>EDVDLTLNWGRLSSVLPDYHGQDSVRVGRISFGSIN<br>AILGSVALILNSHHHASKDEL |
| SEQ ID<br>NO: 76 | multivalent CD20-<br>binding molecule<br>component 30 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGSTSGSGKPGSGEGSQI<br>VLSQSPTILSASPGEKVTMTCRASSSVSYMDWYQQ<br>KPGSSPKWIYATSNLASGVPARFSGSGSGTSYSLTI<br>SRVEAEDAATYYCQQWTSNPPTFGAGTKLELKEFPK<br>PSTPPGSSGGAPKEFTLDFSTAKTYVDSLNVIRSAIG<br>TPLQTISSGGTSLLMIDSGSGDNLFAVDVRGIDPEE<br>GRFNNLRLIVERNNLYVFGFVNRTNNVFYRFADFS<br>HVTFPGTTAVTLSGDSSYTTLQRVAGISRTGMQINR<br>HSLTTSYLDLMSHSGTSLTQSVARAMLRFVTVTAE<br>ALRFRQIQRGFRTTLDDLSGRSYVMTAEDVDLTLN<br>WGRLSSVLPDYHGQDSVRVGRISFGSINAILGSVALI<br>LNSHHHASRVARKDEL |
| SEQ ID<br>NO: 77 | multivalent CD20-<br>binding molecule<br>component 31 | QVQLQQPGAELVKPGASVKMSCKTSGYTFTSYNVH<br>WVKQTPGQGLEWIGAIYPGNGDTSFNQKFKGKATL<br>TADKSSSTVYMQLSSLTSEDSAVYYCARSNYYGSS<br>YVWFFDVWGAGTTVTVSSGGGGSGGGGSGGGGSG<br>GGGSGGGGSQIVLSQSPTILSASPGEKVTMTCRASSS<br>VSYMDWYQQKPGSSPKWIYATSNLASGVPARFSG<br>SGSGTSYSLTISRVEAEDAATYYCQQWTSNPPTFGA<br>GTKLELKEFPKSTPPGSSGGAPGILGFVFTLKEFTL<br>DFSTAKTYVDSLNVIRSAIGTPLQTISSGGTSLLMIDS<br>GSGDNLFAVDVRGIDPEEGRFNNLRLIVERNNLYVT<br>GFVNRTNNVFYRFADFSHVTFPGTTAVTLSGDSSYT<br>TLQRVAGISRTGMQINRHSLTTSYLDLMSHSGTSLT<br>QSVARAMLRFVTVTAEALRFRQIQRGFRTTLDDLS<br>GRSYVMTAEDVDLTLNWGRLSSVLPDYHGQDSVR<br>VGRISFGSINAILGSVALILNSHHHASKDEL |
| SEQ ID<br>NO: 78 | multivalent CD20-<br>binding molecule<br>component 32 | QVQLVQSGAELVKPGASVKMSCKASGYTFTSYNM<br>HWVKQTPGQGLEWIGAIYPGNGDTSYNQKFKGKA<br>TLTADKSSSTAYMQLSSLTSEDSAVYYCARSTYYG<br>GDWYFNVWGAGTTVTVFAGSTSGSGKPGSGEGST<br>KGQIVLSQSPAILSASPGEKVTMTCRASSSVSYMHWF<br>QQKPGSSPKWIYATSNLASGVPARFSGSGSGTSYS |

-continued

| ID Number | Text Description | Biological Sequence |
|---|---|---|
| | | LTISRVEAEDAATYYCQQWTSNPPTFGAGTKLELKE FPKPSTPPGSSGGAPKEFTLDFSTAKTYVDSLNVIRS AIGTPLQTISSGGTSLLMIDSGSGDNLFAVDVRGIDP EEGRFNNLRLIVERNNLYVTGFVNRTNNVFYRFAD FSHVTFPGTTAVTLSGDSSYTTLQRVAGISRTGMQI NRHSLTTSYLDLMSHSGTSLTQSVARAMLRFVTVT AEALRFRQIQRGFRTTLDDLSGRSYVMTAEDVDLT LNWGRLSSVLPDYHGQDSVRVGRISFGSINAILGSV ALILNSHHHASRVAR |
| SEQ ID NO: 79 | multivalent CD20-binding molecule component 33 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARSTYYG GDWYFNVWGAGTTVTVSAGGGGSTKGQIVLSQSP AILSASPGEKVTMTCRASSSVSYIHWFQQKPGSSPK PWIYATSNLASGVPARFSGSGSGTSYSLTISRVEAED AATYYCQQWTSNPPTFGGGTKLEIKGGGGSGGKEF TLDFSTAKTYVDSLNVIRSAIGTPLQTISSGGTSLLMI DSGSGDNLFAVDVRGIDPEEGRFNNLRLIVERNNLY VTGFVNRTNNVFYRFADFSHVTFPGTTAVTLSGDSS YTTLQRVAGISRTGMQINRHSLTTSYLDLMSHSGTS LTQSVARAMLRFVTVTAEALRFRQIQRGFRTTLDDL SGRSYVMTAEDVDLTLNWGRLSSVLPDYHGQDSV RVGRISFGSINAILGSVALILNSHHHASRVARKDEL |
| SEQ ID NO: 80 | multivalent CD20-binding molecule component 34 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARSTYYG GDWYFNVWGAGTTVTVSAGGGGSGGGGSGGGGS GGGGSGGGGSTKGQIVLSQSPAILSASPGEKVTMTC RASSSVSYIHWFQQKPGSSPKPWIYATSNLASGVPV RFSGSGSGTSYSLTISRVEAEDAATYYCQQWTSNPP TFGGGTKLEIKEFPKPSTPPGSSGGAPKEFTLDFSTA KTYVDSLNVIRSAIGTPLQTISSGGTSLLMIDSGTGD NLFAVDVRGIDPEEGRFNNLRLIVERNNLYVTGFVN RTNNVFYRFADFSHVTFPGTTAVTLSGDSSYTTLQR VAGISRTGMQINRHSLTTSYLDLMSHSGTSLTQSVA RAMLRFVTVTAEALRFRQIQRGFRTTLDDLSGRSYV MTAEDVDLTLNWGRLSSVLPDYHGQDSVRVGRISF GSINAILGSVALILNSHHHASRVAR |
| SEQ ID NO: 81 | multivalent CD20-binding molecule component 35 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARSTYYG GDWYFNVWGAGTTVTVSAGGGGSTKGQIVLSQSP AILSASPGEKVTMTCRASSSVSYIHWFQQKPGSSPK PWIYATSNLASGVPVRFSGSGSGTSYSLTISRVEAED AATYYCQQWTSNPPTFGGGTKLEIKEFPKPSTPPGS SGGAPKEFTLDFSTAKTYVDSLNVIRSAIGTPLQTISS GGTSLLMIDSGTGDNLFAVDVRGIDPEEGRFNNLRL IVERNNLYVTGFVNRTNNVFYRFADFSHVTFPGTTA VTLSGDSSYTTLQRVAGISRTGMQINRHSLTTSYLD LMSHSGTSLTQSVARAMLRFVTVTAEALRFRQIQR GFRTTLDDLSGRSYVMTAEDVDLTLNWGRLSSVLP DYHGQDSVRVGRISFGSINAILGSVALILNSHHHAS RVAR |
| SEQ ID NO: 82 | multivalent CD20-binding molecule component 36 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARSTYYG GDWYFNVWGAGTTVTVSAGSTSGSGKPGSGEGST KGQIVLSQSPAILSASPGEKVTMTCRASSSVSYIHWF QQKPGSSPKPWIYATSNLASGVPVRFSGSGSGTSYS LTISRVEAEDAATYYCQQWTSNPPTFGGGTKLEIKE FPKPSTPPGSSGGAPKEFTLDFSTAKTYVDSLNVIRS AIGTPLQTISSGGTSLLMIDSGTGDNLFAVDVRGIDP EEGRFNNLRLIVERNNLYVTGFVNRTNNVFYRFAD FSHVTFPGTTAVTLSGDSSYTTLQRVAGISRTGMQI NRHSLTTSYLDLMSHSGTSLTQSVARAMLRFVTVT AEALRFRQIQRGFRTTLDDLSGRSYVMTAEDVDLT LNWGRLSSVLPDYHGQDSVRVGRISFGSINAILGSV ALILNSHHHASRVAR |

-continued

Sequence Listing

| ID Number | Text Description | Biological Sequence |
|---|---|---|
| SEQ ID NO: 83 | multivalent CD20-binding molecule component 37 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARSTYYG GDWYFNVWGAGTTVTVSAGSTSGSGKPGSGEGST KGQIVLSQSPAILSASPGEKVTMTCRASSSVSYIHWF QQKPGSSPKPWIYATSNLASGVPVRFSGSGSGTSYS LTISRVEAEDAATYYCQQWTSNPPTFGGGTKLEIKE FPKPSTPPGSSGGAPGILGFVFTLKEFTLDFSTAKTY VDSLNVIRSAIGTPLQTISSGGTSLLMIDSGTGDNLF AVDVRGIDPEEGRFNNLRLIVERNNLYVTGFVNRTN NVFYRFADFSHVTFPGTTAVTLSGDSSYTTLQRVAG ISRTGMQINRHSLTTSYLDLMSHSGTSLTQSVARAM LRFVTVTAEALRFRQIQRGFRTTLDDLSGRSYVMTA EDVDLTLNWGRLSSVLPDYHGQDSVRVGRISFGSIN AILGSVALILNSHHASAVAA |
| SEQ ID NO: 84 | multivalent CD20-binding molecule component 38 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARSTYYG GDWYFNVWGAGTTVTVSAGSTSGSGKPGSGEGST KGQIVLSQSPAILSASPGEKVTMTCRASSSVSYIHWF QQKPGSSPKPWIYATSNLASGVPVRFSGSGSGTSYS LTISRVEAEDAATYYCQQWTSNPPTFGGGTKLEIKE FPKPSTPPGSSGGAPKEFTLDFSTAKTYVDSLNVIRS AIGTPLQTISSGGTSLLMIDSGTGDNLFAVDVRGIDP EEGRFNNLRLIVERNNLYVTGFVNRTNNVFYRFAD FSHVTFPGTTAVTLSGDSSYTTLQRVAGISRTGMQI NRHSLTTSYLDLMSHSGTSLTQSVARAMLRFVTVT AEALRFRQIQRGFRTTLDDLSGRSYVMTAEDVDLT LNWGRLSSVLPDYHGQDSVRVGRISFGSINAILGSV ALILNSHHASRVAR |
| SEQ ID NO: 85 | multivalent CD20-binding molecule component 39 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARSTYYG GDWYFNVWGAGTTVTVSAGGGGSGGGGSGGGGS GGGGSGGGGSTKGQIVLSQSPAILSASPGEKVTMTC RASSSVSYIHWFQQKPGSSPKPWIYATSNLASGVPV RFSGSGSGTSYSLTISRVEAEDAATYYCQQWTSNPP TFGGGTKLEIKGGGGSGGKEFTLDFSTAKTYVDSLN VIRSAIGTPLQTISSGGTSLLMIDSGTGDNLFAVDVR GIDPEEGRFNNLRLIVERNNLYVTGFVNRTNNVFYR FADFSHVTFPGTTAVTLSGDSSYTTLQRVAGISRTG MQINRHSLTTSYLDLMSHSGTSLTQSVARAMLRFV TVTAEALRFRQIQRGFRTTLDDLSGRSYVMTAEDV DLTLNWGRLSSVLPDYHGQDSVRVGRISFGSINAIL GSVALILNSHHASRVAR |
| SEQ ID NO: 86 | multivalent CD20-binding molecule component 40 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARSTYYG GDWYFNVWGAGTTVTVSAGGGGSTKGQIVLSQSP AILSASPGEKVTMTCRASSSVSYIHWFQQKPGSSPK PWIYATSNLASGVPVRFSGSGSGTSYSLTISRVEAED AATYYCQQWTSNPPTFGGGTKLEIKGGGGSGGKEF TLDFSTAKTYVDSLNVIRSAIGTPLQTISSGGTSLLMI DSGTGDNLFAVDVRGIDPEEGRFNNLRLIVERNNLY VTGFVNRTNNVFYRFADFSHVTFPGTTAVTLSGDSS YTTLQRVAGISRTGMQINRHSLTTSYLDLMSHSGTS LTQSVARAMLRFVTVTAEALRFRQIQRGFRTTLDDL SGRSYVMTAEDVDLTLNWGRLSSVLPDYHGQDSV RVGRISFGSINAILGSVALILNSHHASRVAR |
| SEQ ID NO: 87 | multivalent CD20-binding molecule component 41 | QVQLVQSGAELVKPGASVKMSCKASGYTFTSYNM HWVKQTPGQGLEWIGAIYPGNGDTSYNQKFKGKA TLTADKSSSTAYMQLSSLTSEDSAVYYCARSTYYG GDWYFNVWGAGTTVTVSAGSTSGSGKPGSGEGST KGQIVLSQSPAILSASPGEKVTMTCRASSSVSYIHWF QQKPGSSPKPWIYATSNLASGVPVRFSGSGSGTSYS LTISRVEAEDAATYYCQQWTSNPPTFGGGTKLEIKE FPKPSTPPGSSGGAPKEFTLDFSTAKTYVDSLNVIRS AIGTPLQTISSGGTSLLMIDSGTGDNLFAVDVRGIDP EEGRFNNLRLIVERNNLYVTGFVNRTNNVFYRFAD FSHVTFPGTTAVTLSGDSSYTTLQRVAGISRTGMQI NRHSLTTSYLDLMSHSGTSLTQSVARAMLRFVTVT |

| ID Number | Text Description | Biological Sequence |
|---|---|---|
| | | AEALRFRQIQRGFRTTLDDLSGRSYVMTAEDVDLT<br>LNWGRLSSVLPDYHGQDSVRVGRISFGSINAILGSV<br>ALILNSHHHAS |
| SEQ ID NO: 88 | multivalent CD20-<br>binding molecule<br>component 42 | QVQLVQSGAELVKPGASVKMSCKASGYTFTSYNM<br>HWVKQTPGQGLEWIGAIYPGNGDTSYNQKFKGKA<br>TLTADKSSSTAYMQLSSLTSEDSAVYYCARSTYYG<br>GDWYFNVWGAGTTVTVSAGSTSGSGKPGSGEGST<br>KGQIVLSQSPAILSASPGEKVTMTCRASSSVSYIHWF<br>QQKPGSSPKPWIYATSNLASGVPVRFSGSGSGTSYS<br>LTISRVEAEDAATYYCQQWTSNPPTFGGGTKLEIKE<br>FPKPSTPPGSSGGAPKEFTLDFSTAKTYVDSLNVIRS<br>AIGTPLQTISSGGTSLLMIDSGTGDNLFAVDVRGIDP<br>EEGRFNNLRLIVERNNLYVTGFVNRTNNVFYRFAD<br>FSHVTFPGTTAVTLSGDSSYTTLQRVAGISRTGMQI<br>NRHSLTTSYLDLMSHSGTSLTQSVARAMLRFVTVT<br>AEALRFRQIQRGFRTTLDDLSGRSYVMTAEDVDLT<br>LNWGRLSSVLPDYHGQDSVRVGRISFGSINAILGSV<br>ALILNSHHHASRVAR |
| SEQ ID NO: 89 | multivalent CD20-<br>binding molecule<br>component 43 | QVQLVQSGAELVKPGASVKMSCKASGYTFTSYNM<br>HWVKQTPGQGLEWIGAIYPGNGDTSYNQKFKGKA<br>TLTADKSSSTAYMQLSSLTSEDSAVYYCARSTYYG<br>GDWYFNVWGAGTTVTVSAGSTSGSGKPGSGEGST<br>KGQIVLSQSPAILSASPGEKVTMTCRASSSVSYIHWF<br>QQKPGSSPKPWIYATSNLASGVPVRFSGSGSGTSYS<br>LTISRVEAEDAATYYCQQWTSNPPTFGGGTKLEIKE<br>FPKPSTPPGSSGGAPGILGFVFTLKEFTLDFSTAKTY<br>VDSLNVIRSAIGTPLQTISSGGTSLLMIDSGTGDNLF<br>AVDVRGIDPEEGRFNNLRLIVERNNLYVTGFVNRTN<br>NVFYRFADFSHVTFPGTTAVTLSGDSSYTTLQRVAG<br>ISRTGMQINRHSLTTSYLDLMSHSGTSLTQSVARAM<br>LRFVTVTAEALRFRQIQRGFRTTLDDLSGRSYVMTA<br>EDVDLTLNWGRLSSVLPDYHGQDSVRVGRISFGSIN<br>AILGSVALILNSHHHASKDEL |
| SEQ ID NO: 90 | multivalent CD20-<br>binding molecule<br>component 44 | EIVLTQSPATLSLSPGERATLSCRASQSVSSYLAWY<br>QQKPGQAPRLLIYDASNRATGIPARFSGSGSGTDFT<br>LTISSLEPEDFAVYYCQQRSNWPITFGQGTREILKGS<br>TSGSGKPGSGEGSEVQINESGGGLVQPGRSLRLSCA<br>ASGFFFNDYAMHWVROAPGKGLEWVSTISWNSGSI<br>GYADSVKGRFTISRDNAKKSLYLQMNSIRAEDTAL<br>YYCAKDIQYGNYYYGNIDVAVGQGTIVTVSSEFPKP<br>STPPGSSGGAPKEFTLDFSEkKTYVDSLNVIRSAIGT<br>PLQTISSGGTSLLMIDSGSGDNLFAVDVRGIDPEEGR<br>FNNLRLIVERNNLYVTGTVNRTNNVFYRFADFSHV<br>TFPGTTAVTLSGDSSYTTLQRVAGISRTGMQINRHS<br>LTTSYLDLMSHSGTSLTQSVARAMLRFVTVTAEAL<br>RFRQIQRGFKTTLDDLSGRSYVMTAEDVDLTLNWG<br>RLSSVLPDYHGQDSVRVGRISFGSINAILGSVALILN<br>CHHHASRVAR |
| SEQ ID NO: 91 | multivalent CD20-<br>binding molecule<br>component 45 | EIVLTQSPATLSLSPGERATLSCRASQSVSSYLAWY<br>QQKPGQAPRLLIYDASNRATGIPARFSGSGSGTDFT<br>LTISSLEPEDFAVYYCQQRSNWPITFGQGTREILKGG<br>GGSEVQINESGGGLVQPGRSLRLSCAASGFFFNDY<br>AMHWVROAPGKGLEWVSTISWNSGSIGYADSVKG<br>RFTISRDNAKKSLYLQMNSIRAEDTALYYCAKDIQ<br>YGNYYYGNIDVAVGQGTIVTVSSEFPKPSTPPGSSGG<br>APKEFTLDFSEkKTYVDSLNVIRSAIGTPLQTISSGG<br>TSLLMIDSGSGDNLFAVDVRGIDPEEGRFNNLRLIVE<br>RNNLYVTGTVNRTNNVFYRFADFSHVTFPGTTAVT<br>LSGDSSYTTLQRVAGISRTGMQINRHSLTTSYLDLM<br>SHSGTSLTQSVARAMLRFVTVTAEALRFRQIQRGFR<br>TTLDDLSGRSYVMTAEDVDLTLNWGRLSSVLPDYH<br>GQDSVRVGRISFGSINAILGSVALILNSHHHASRVAR |
| SEQ ID NO: 92 | multivalent CD20-<br>binding molecule<br>component 46 | EIVLTQSPATLSLSPGERATLSCRASQSVSSYLAWY<br>QQKPGQAPRLLIYDASNRATGIPARFSGSGSGTDFT<br>LTISSLEPEDFAVYYCQQRSNWPITFGQGTREILKGS<br>TSGSGKPGSGEGSEVQINESGGGLVQPGRSLRLSCA<br>ASGFFFNDYAMHWVROAPGKGLEWVSTISWNSGSI<br>GYADSVKGRFTISRDNAKKSLYLQMNSIRAEDTAL<br>YYCAKDIQYGNYYYGNIDVAVGQGTIVTVSSEFPKP<br>STPPGSSGGAPKEFTLDFSTAKTYVDSLNVIRSAIGT |

| ID Number | Text Description | Biological Sequence |
|---|---|---|
| | | PLQTISSGGTSLLMIDSGSGDNLFAVDVRGIDPEEGR FNNLRLIVERNNLYVTGTVNRTNNVFYRFADFSHV TFPGTTAVTLSGDSSYTTLQRVAGISRTGMQINRHS LTTSYLDLMSHSGTSLTQSVARAMLRFVTVTAEAL RFRQIQRGFKTTLDDLSGRSYVMTAEDVDLTLNWG RLSSVLPDYHGQDSVRVGRISFGSINAILGSVALILN CHHHASRVAR |
| SEQ ID NO: 93 | multivalent CD20-binding molecule component 47 | EIVLTQSPATLSLSPGERATLSCRASQSVSSYLAWY QQKPGQAPRLLIYDASNRATGIPARFSGSGSGTDFT LTISSLEPEDFAVYYCQQRSNWPITFGQGTREILKGS TSGSGKPGSGEGSEVQINESGGGLVQPGRSLRLSCA ASGFFFNDYAMHWVRQAPGKGLEWVSTISWNSGSI GYADSVKGRFTISRDNAKKSLYLQMNSIRAEDTAL YYCAKDIQYGNYYYGNIDVAVGQGTIVTVSSEFPKP STPPGSSGGAPKEFTLDFSTAKTYVDSLNVIRSAIGT PLQTISSGGTSLLMIDSGSGDNLFAVDVRGIDPEEGR FNNLRLIVERNNLYVTGTVNRTNNVFYRFADFSHV TFPGTTAVTLSGDSSYTTLQRVAGISRTGMQINRHS LTTSYLDLMSHSGTSLTQSVARAMLRFVTVTAEAL RFRQIQRGFKTTLDDLSGRSYVMTAEDVDLTLNWG RLSSVLPDYHGQDSVRVGRISFGSINAILGSVALILN CHHHASRVAR |
| SEQ ID NO: 94 | multivalent CD20-binding molecule component 48 | EIVLTQSPATLSLSPGERATLSCRASQSVSSYLAWY QQKPGQAPRLLIYDASNRATGIPARFSGSGSGTDFT LTISSLEPEDFAVYYCQQRSNWPITFGQGTREILKGS TSGSGKPGSGEGSEVQINESGGGLVQPGRSLRLSCA ASGFFFNDYAMHWVRQAPGKGLEWVSTISWNSGSI GYADSVKGRFTISRDNAKKSLYLQMNSIRAEDTAL YYCAKDIQYGNYYYGNIDVAVGQGTIVTVSSEFPKP STPPGSSGGAPKEFTLDFSTAKTYVDSLNVIRSAIGT PLQTISSGGTSLLMIDSGSGDNLFAVDVRGIDPEEGR FNNLRLIVERNNLYVTGTVNRTNNVFYRFADFSHV TFPGTTAVTLSGDSSYTTLQRVAGISRTGMQINRHS LTTSYLDLMSHSGTSLTQSVARAMLRFVTVTAEAL RFRQIQRGFKTTLDDLSGRSYVMTAEDVDLTLNWG RLSSVLPDYHGQDSVRVGRISFGSINAILGSVALILN CHHHASRVAR |
| SEQ ID NO: 95 | multivalent CD20-binding molecule component 49 | EIVLTQSPATLSLSPGERATLSCRASQSVSSYLAWY QQKPGQAPRLLIYDASNRATGIPARFSGSGSGTDFT LTISSLEPEDFAVYYCQQRSNWPITFGQGTREILKGG GGSGGGGSGGGGSGGGGSGGGGSEVQLVESGGGL VQPGRSLRLSCAASGFFFNDYAMHWVRQAPGKGL EWVSTISWNSGSIGYADSVKGRFTISRDNAKKSLYL QMNSIRAEDTALYYCAKDIQYGNYYYGNIDVAVGQ GTTVTVSSEFPKPSTPPGSSGGAPKEFTLDFSTAKTY VDSLNVIRSAIGTPLQTISSGGTSLLMIDSGSGDNLF AVDVRGIDPEEGRFNNLRLIVERNNLYVTGTVNRTN NVFYRFADFSHVTFPGTTAVTLSGDSSYTTLQRVAG ISRTGMQINRHSLTTSYLDLMSHSGTSLTQSVARAM LRFVTVTAEALRFRQIQRGFRTTLDDLSGRSYVMTA EDVDLTLNWGRLSSVLPDYHGQDSVRVGRISFGSIN AILGSVALILNSHHASAVAA |
| SEQ ID NO: 96 | multivalent CD20-binding molecule component 50 | QIVLSQSPAILSASPGEKVTMTCRASSSVSYMHWYQ QKPGSSPKPWIYAPSNLASGVPARFSGSGSGTSYSLT ISRVEAEDAATYYCQQWSFNPPTFGAGTKLELKSGS TSGSGKPGSGEGSQAYLQQSGAELVRPGASVKMSC KASGYTFTSYNMHWVKQTPRQGLEWIGAIYPGNG DTSYNQKFKGKATLTVDKSSSTAYMQLSSLTSEDS AVYFCARVVYYSNSYWYFDVWGTGTTVTVSEFPK PSTPPGSSGGAPKEFTLDFSTAKTYVDSLNVIRSAIG TPLQTISSGGTSLLMIDSGSGDNLFAVDVRGIDPEEG RFNNLRLIVERNNLYVTGFVNRTNNVFYRFADFSH VTFPGTTAVTLSGDSSYTTLQRVAGISRTGMQINRH SETTSYLDLMSHSGTSLTQSVARAMLRFVTVTAEA LRFRQIQRGFRTTLDDLSGRSYVMTAEDVDLTLNW GRLSSVLPDYHGQDSVRVGRISFGSINAILGSVALIL NSHHASRVARKDEL |
| SEQ ID NO: 97 | multivalent CD20-binding molecule component 51 | QIVLSQSPAILSASPGEKVTMTCRASSSVSYMHWYQ QKPGSSPKPWIYAPSNLASGVPARFSGSGSGTSYSLT ISRVEAEDAATYYCQQWSFNPPTFGAGTKLELKSG |

| ID Number | Text Description | Biological Sequence |
|---|---|---|
| | | GGGSGGGGSGGGGSGGGGSGGGGSQAYLQQSGAE<br>LVRPGASVKMSCKASGYTFTSYNMHWVKQTPRQG<br>LEWIGAIYPGNGDTSYNQKFKGKATLTVDKSSSTA<br>YMQLSSLTSEDSAVYFCARVVYYSNSYWYFDVWG<br>TGTTVTVSGGGGSGGKEFTLDFSTAKTYVDSLNVIR<br>SAIGTPLQTISSGGTSLLMIDSGSGDNLFAVDVRGID<br>PEEGRFNNLRLIVERNNLYVTGFVNRTNNVFYRFA<br>DFSHVTFPGTTAVTLSGDSSYTTLQRVAGISRTGMQ<br>INRHSLTTSYLDLMSHSGTSLTQSVARAMLRFVTVT<br>AEALRFRQIQRGFRTTLDDLSGRSYVMTAEDVDLT<br>LNWGRLSSVLPDYHGQDSVRVGRISFGSINAILGSV<br>ALILNSHHHASRVAR |
| SEQ ID NO: 98 | multivalent CD20-<br>binding molecule<br>component 52 | QIVLSQSPAILSASPGEKVTMTCRASSSVSYMHWYQ<br>QKPGSSPKPWIYAPSNLASGVPARFSGSGSGTSYSLT<br>ISRVEAEDAATYYCQQWSFNPPTFGAGTKLELKSG<br>GGGSGGGGSGGGGSGGGGSGGGGSQAYLQQSGAE<br>LVRPGASVKMSCKASGYTFTSYNMHWVKQTPRQG<br>LEWIGAIYPGNGDTSYNQKFKGKATLTVDKSSSTA<br>YMQLSSLTSEDSAVYFCARVVYYSNSYWYFDVWG<br>TGTTVTVSGGGGSGGKEFTLDFSTAKTYVDSLNVIR<br>SAIGTPLQTISSGGTSLLMIDSGSGDNLFAVDVRGID<br>PEEGRFNNLRLIVERNNLYVTGFVNRTNNVFYRFA<br>DFSHVTFPGTTAVTLSGDSSYTTLQRVAGISRTGMQ<br>INRHSLTTSYLDLMSHSGTSLTQSVARAMLRFVTVT<br>AEALRFRQIQRGFRTTLDDLSGRSYVMTAEDVDLT<br>LNWGRLSSVLPDYHGQDSVRVGRISFGSINAILGSV<br>ALILNSHHHASRVAR |
| SEQ ID NO: 99 | multivalent CD20-<br>binding molecule<br>component 53 | QIVLSQSPAILSASPGEKVTMTCRASSSVSYMHWYQ<br>QKPGSSPKPWIYAPSNLASGVPARFSGSGSGTSYSLT<br>ISRVEAEDAATYYCQQWSFNPPTFGAGTKLELKSGS<br>TSGSGKPGSGEGSQAYLQQSGAELVRPGASVKMSC<br>KASGYTFTSYNMHWVKQTPRQGLEWIGAIYPGNG<br>DTSYNQKFKGKATLTVDKSSSTAYMQLSSLTSEDS<br>AVYFCARVVYYSNSYWYFDVWGTGTTVTVSGGG<br>GSGGKEFTLDFSTAKTYVDSLNVIRSAIGTPLQTISS<br>GGTSLLMIDSGSGDNLFAVDVRGIDPEEGRFNNLRL<br>IVERNNLYVTGFVNRTNNVFYRFADFSHVTFPGTTA<br>VTLSGDSSYTTLQRVAGISRTGMQINRHSLTTSYLD<br>LMSHSGTSLTQSVARAMLRFVTVTAEALRFRQIQR<br>GFRTTLDDLSGRSYVMTAEDVDLTLNWGRLSSVLP<br>DYHGQDSVRVGRISFGSINAILGSVALILNSHHHAS |
| SEQ ID NO: 100 | multivalent CD20-<br>binding molecule<br>component 54 | QIVLSQSPAILSASPGEKVTMTCRASSSVSYMHWYQ<br>QKPGSSPKPWIYAPSNLASGVPARFSGSGSGTSYSLT<br>ISRVEAEDAATYYCQQWSFNPPTFGAGTKLELKSG<br>GGGSQAYLQQSGAELVRPGASVKMSCKASGYTFTS<br>YNMHWVKQTPRQGLEWIGAIYPGNGDTSYNQFK<br>GKATLTVDKSSSTAYMQLSSLTSEDSAVYFCARVV<br>YYSNSYWYFDVWGTGTTVTVSGGGGSGGKEFTLD<br>FSTAKTYVDSLNVIRSAIGTPLQTISSGGTSLLMIDNL<br>VPMVATVVDVRGIDPEEGRFNNLRLIVERNNLYVT<br>GFVNRTNNVFYRFADFSHVTFPGTTAVTLSGDSSYT<br>TLQRVAGISRTGMQINRHSLTTSYLDLMSHSGTSLT<br>QSVARAMLRFVTVTAEALRFRQIQRGFRTTLDDLS<br>GRSYVMTAEDVDLTLNWGRLSSVLPDYHGQDSVR<br>VGRISFGSINAILGSVALILNSHHHASRVAR |
| SEQ ID NO: 101 | multivalent CD20-<br>binding molecule<br>component 55 | QIVLSQSPAILSASPGEKVTMTCRASSSVSYMHWYQ<br>QKPGSSPKPWIYAPSNLASGVPARFSGSGSGTSYSLT<br>ISRVEAEDAATYYCQQWSFNPPTFGAGTKLELKSGS<br>TSGSGKPGSGEGSQAYLQQSGAELVRPGASVKMSC<br>KASGYTFTSYNMHWVKQTPRQGLEWIGAIYPGNG<br>DTSYNQKFKGKATLTVDKSSSTAYMQLSSLTSEDS<br>AVYFCARVVYYSNSYWYFDVWGTGTTVTVSEFPK<br>PSTPPGSSGGAPKEFTLDFSTAKTYVDSLNVIRSAIG<br>TPLQTISSGGTSLLMIDSGSGDNLFAVDVRGIDPEEG<br>RFNNLRLIVERNNLYVTGFVNRTNNVFYRFADFSH<br>VTFPGTTAVTLSGDSSYTTLQRVAGISRTGMQINRH<br>SETTSYLDLMSHSGTSLTQSVARAMLRFVTVTAEA<br>LRFRQIQRGFRTTLDDLSGRSYVMTAEDVDLTLNW<br>GRLSSVLPDYHGQDSVRVGRISFGSINAILGSVALIL<br>NSHHHAS |

-continued

| Sequence Listing | | |
|---|---|---|
| ID Number | Text Description | Biological Sequence |
| SEQ ID NO: 102 | multivalent CD20-binding molecule component 56 | QAYLQQSGAELVRPGASVKMSCKASGYTFTSYNM HWVKQTPRQGLEWIGAIYPGNGDTSYNQKFKGKA TLTVDKSSSTAYMQLSSLTSEDSAVYFCARVVYYS NSYWYFDVWGTGTTVTVSGSTSGSGKPGSGEGSQI VLSQSPAILSASPGEKVTMTCRASSSVSYMHWYQQ KPGSSPKPWIYAPSNLASGVPARFSGSGSGTSYSLTI SRVEAEDAATYYCQQWSFNPPTFGAGTKLELKSEF PKPSTPPGSSGGAPKEFTLDFSTAKTYVDSLNVIRSA IGTPLQTISSGGTSLLMIDSGSGDNLFAVDVRGIDPE EGRFNNLRLIVERNNLYVTGFVNRTNNVFYRFADFS HVTFPGTTAVTLSGDSSYTTLQRVAGISRTGMQINR HSLTTSYLDLMSHSGTSLTQSVARAMLRFVTVTAE ALRFRQIQRGFRTTLDDLSGRSYVMTAEDVDLTLN WGRLSSVLPDYHGQDSVRVGRISFGSINAILGSVALI LNSHHHASVAR |
| SEQ ID NO: 103 | multivalent CD20-binding molecule component 57 | QAYLQQSGAELVRPGASVKMSCKASGYTFTSYNM HWVKQTPRQGLEWIGAIYPGNGDTSYNQKFKGKA TLTVDKSSSTAYMQLSSLTSEDSAVYFCARVVYYS NSYWYFDVWGTGTTVTVSGSTSGSGKPGSGEGSQI VLSQSPAILSASPGEKVTMTCRASSSVSYMHWYQQ KPGSSPKPWIYAPSNLASGVPARFSGSGSGTSYSLTI SRVEAEDAATYYCQQWSFNPPTFGAGTKLELKSGG GGSGGKEFTLDFSTAKTYVDSLNVIRSAIGTPLQTIS SGGTSLLMIDSGSGDNLFAVDVRGIDPEEGRFNNLR LIVERNNLYVTGFVNRTNNVFYRFADFSHVTFPGTT AVTLSGDSSYTTLQRVAGISRTGMQINRHSLTTSYL DLMSHSGTSLTQSVARAMLRFVTVTAEALRFRQIQ RGFRTTLDDLSGRSYVMTAEDVDLTLNWGRLSSVL PDYHGQDSVRVGRISFGSINAILGSVALILNSHHHAS RVAR |
| SEQ ID NO: 104 | multivalent CD20-binding molecule component 58 | QAYLQQSGAELVRPGASVKMSCKASGYTFTSYNM HWVKQTPRQGLEWIGAIYPGNGDTSYNQKFKGKA TLTVDKSSSTAYMQLSSLTSEDSAVYFCARVVYYS NSYWYFDVWGTGTTVTVSGSTSGSGKPGSGEGSQI VLSQSPAILSASPGEKVTMTCRASSSVSYMHWYQQ KPGSSPKPWIYAPSNLASGVPARFSGSGSGTSYSLTI SRVEAEDAATYYCQQWSFNPPTFGAGTKLELKSGG GGSGGKEFTLDFSTAKTYVDSLNVIRSAIGTPLQTIS SGGTSLLMIDSGSGDNLFAVDVRGIDPEEGRFNNLR LIVERNNLYVTGFVNRTNNVFYRFADFSHVTFPGTT AVTLSGDSSYTTLQRVAGISRTGMQINRHSLTTSYL DLMSHSGTSLTQSVARAMLRFVTVTAEALRFRQIQ RGFRTTLDDLSGRSYVMTAEDVDLTLNWGRLSSVL PDYHGQDSVRVGRISFGSINAILGSVALILNSHHHAS RVAR |
| SEQ ID NO: 105 | multivalent CD20-binding molecule component 59 | QAYLQQSGAELVRPGASVKMSCKASGYTFTSYNM HWVKQTPRQGLEWIGAIYPGNGDTSYNQKFKGKA TLTVDKSSSTAYMQLSSLTSEDSAVYFCARVVYYS NSYWYFDVWGTGTTVTVSGGGGSQIVLSQSPAILS ASPGEKVTMTCRASSSVSYMHWYQQKPGSSPKPWI YAPSNLASGVPARFSGSGSGTSYSLTISRVEAEDAA TYYCQQWSFNPPTFGAGTKLELKSGGGGSGGKEFT LDFSTAKTYVDSLNVIRSAIGTPLQTISSGGTSLLMID SGSGDNLFAVDVRGIDPEEGRFNNLRLIVERNNLYV TGFVNRTNNVFYRFADFSHVTFPGTTAVTLSGDSSY TTLQRVAGISRTGMQINRHSLTTSYLDLMSHSGTSL TQSVARAMLRFVTVTAEALRFRQIQRGFRTTLDDLS GRSYVMTAEDVDLTLNWGRLSSVLPDYHGQDSVR VGRISFGSINAILGSVALILNSHHHASRVAR |
| SEQ ID NO: 106 | multivalent CD20-binding molecule component 60 | QAYLQQSGAELVRPGASVKMSCKASGYTFTSYNM HWVKQTPRQGLEWIGAIYPGNGDTSYNQKFKGKA TLTVDKSSSTAYMQLSSLTSEDSAVYFCARVVYYS NSYWYFDVWGTGTTVTVSGGGGSGGGGSGGGGSG GGGSGGGGSQIVLSQSPAILSASPGEKVTMTCRASS SVSYMHWYQQKPGSSPKPWIYAPSNLASGVPARFS GSGSGTSYSLTISRVEAEDAATYYCQQWSFNPPTFG AGTKLELKSEFPKPSTPPGSSGGAPKEFTLDFSTAKT YVDSLNVIRSAIGTPLQTISSGGTSLLMIDNLVPMVA TVVDVRGIDPEEGRFNNLRLIVERNNLYVTGFVNRT NNVFYRFADFSHVTFPGTTAVTLSGDSSYTTLQRVA GISRTGMQINRHSLTTSYLDLMSHSGTSLTQSVARA |

| | | Sequence Listing |
|---|---|---|
| ID Number | Text Description | Biological Sequence |
| | | MLRFVTVTAEALRFRQIQRGFRTTLDDLSGRSYVM<br>TAEDVDLTLNWGRLSSVLPDYHGQDSVRVGRISFG<br>SINAILGSVALILNSHHHASRVAR |
| SEQ ID NO: 107 | multivalent CD20-<br>binding molecule<br>component 61 | QAYLQQSGAELVRPGASVKMSCKASGYTFTSYNM<br>HWVKQTPRQGLEWIGAIYPGNGDTSYNQKFKGKA<br>TLTVDKSSSTAYMQLSSLTSEDSAVYFCARVVYYS<br>NSYWYFDVWGTGTTVTVSGGGGSQIVLSQSPAILS<br>ASPGEKVTMTCRASSSVSYMHWYQQKPGSSPKPWI<br>YAPSNLASGVPARFSGSGSGTSYSLTISRVEAEDAA<br>TYYCQQWSFNPPTFGAGTKLELKSGGGGSGGKEFT<br>LDFSTAKTYVDSLNVIRSAIGTPLQTISSGGTSLLMID<br>SGSGDNLFAVDVRGIDPEEGRFNNLRLIVERNNLYV<br>TGFVNRTNNVFYRFADFSHVTFPGTTAVTLSGDSSY<br>TTLQRVAGISRTGMQINRHSLTTSYLDLMSHSGTSL<br>TQSVARAMLRFVTVTAEALRFRQIQRGFRTTLDDLS<br>GRSYVMTAEDVDLTLNWGRLSSVLPDYHGQDSVR<br>VGRISFGSINAILGSVALILNSHHHASAVAA |
| SEQ ID NO: 108 | multivalent CD20-<br>binding molecule<br>component 62 | QVQLVQSGAEVKKPGSSVKVSCKASGYAFSYSWIN<br>WVRQAPGQGLEWMGRIFPGDGDTDYNGKFKGRVT<br>ITADKSTSTAYMELSSLRSEDTAVYYCARNVFDGY<br>WLVYWGQGTLVTVSSGSTSGSGKPGSGEGSDIVMT<br>QTPLSLPVTPGEPASISCRSSKSLLHSNGITYLYWYL<br>QKPGQSPQLLIYQMSNLVSGVPDRFSGSGSGTDFFL<br>KISRVEAEDVGVYYCAQNLELPYTFGGGTKVEIKEF<br>PKPSTPPGSSGGAPKEFTLDFSTAKTYVDSLNVIRSA<br>IGTPLQTISSGGTSLLMIDSGSGDNLFAVDVRGIDPE<br>EGRFNNLRLIVERNNLYVTGFVNRTNNVFYRFADFS<br>HVTFPGTTAVTLSGDSSYTTLQRVAGISRTGMQINR<br>HSLTTSYLDLMSHSGTSLTQSVARAMLREVTVTAE<br>ALRFRQIQRGFRTTLDDLSGRSYVMTAEDVDLTLN<br>WGRLSSVLPDYHGQDSVRVGRISFGSINAILGSVALI<br>LNSHHHASRVAR |
| SEQ ID NO: 109 | multivalent CD20-<br>binding molecule<br>component 63 | QVQLVQSGAEVKKPGSSVKVSCKASGYAFSYSWIN<br>WVRQAPGQGLEWMGRIFPGDGDTDYNGKFKGRVT<br>ITADKSTSTAYMELSSLRSEDTAVYYCARNVFDGY<br>WLVYWGQGTLVTVSSGSTSGSGKPGSGEGSDIVMT<br>QTPLSLPVTPGEPASISCRSSKSLLHSNGITYLYWYL<br>QKPGQSPQLLIYQMSNLVSGVPDRFSGSGSGTDFTL<br>KISRVEAEDVGVYYCAQNLELPYTFGGGTKVEIKEF<br>PKPSTPPGSSGGAPGILGFVFTLKEFTLDFSTAKTYV<br>DSLNVIRSAIGTPLQTISSGGTSLLMIDSGSGDNLFA<br>VDVRGIDPEEGRFNNLRLIVERNNLYVTGFVNRTNN<br>VFYRFADFSHVTFPGTTAVTLSGDSSYTTLQRVAGI<br>SRTGMQINRHSLTTSYLDLMSHSGTSLTQSVARAM<br>LRFVTVTAEALRFRQIQRGFRTTLDDLSGRSYVMTA<br>EDVDLTLNWGRLSSVLPDYHGQDSVRVGRISFGSIN<br>AILGSVALILNSHHHASRVAR |
| SEQ ID NO: 110 | multivalent CD20-<br>binding molecule<br>component 64 | QVQLVQSGAEVKKPGSSVKVSCKASGYAFSYSWIN<br>WVRQAPGQGLEWMGRIFPGDGDTDYNGKFKGRVT<br>ITADKSTSTAYMELSSLRSEDTAVYYCARNVFDGY<br>WLVYWGQGTLVTVSSGGGGSDIVMTQTPLSLPVTP<br>GEPASISCRSSKSLLHSNGITYLYWYLQKPGQSPQLL<br>IYQMSNLVSGVPDRFSGSGSGTDFTLKISRVEAEDV<br>GVYYCAQNLELPYTFGGGTKVEIKEFPKPSTPPGSS<br>GGAPGILGFVFTLKEFTLDFSTAKTYVDSLNVIRSAI<br>GTPLQTISSGGTSLLMIDSGSGDNLFAVDVRGIDPEE<br>GRFNNLRLIVERNNLYVTGFVNRTNNVFYRFADFS<br>HVTFPGTTAVTLSGDSSYTTLQRVAGISRTGMQINR<br>HSLTTSYLDLMSHSGTSLTQSVARAMLRFVTVTAE<br>ALRFRQIQRGFRTTLDDLSGRSYVMTAEDVDLTLN<br>WGRLSSVLPDYHGQDSVRVGRISFGSINAILGSVALI<br>LNSHHHASRVAR |
| SEQ ID NO: 111 | multivalent CD20-<br>binding molecule<br>component 65 | QVQLVQSGAEVKKPGSSVKVSCKASGYAFSYSWIN<br>WVRQAPGQGLEWMGRIFPGDGDTDYNGKFKGRVT<br>ITADKSTSTAYMELSSLRSEDTAVYYCARNVFDGY<br>WLVYWGQGTLVTVSSGGGGSDIVMTQTPLSLPVTP<br>GEPASISCRSSKSLLHSNGITYLYWYLQKPGQSPQLL<br>IYQMSNLVSGVPDRFSGSGSGTDFTLKISRVEAEDV<br>GVYYCAQNLELPYTFGGGTKVEIKEFPKPSTPPGSS<br>GGAPGILGFVFTLKEFTLDFSTAKTYVDSLNVIRSAI |

| ID Number | Text Description | Biological Sequence |
|---|---|---|
| | | GTPLQTISSGGTSLLMIDSGSGDNLFAVDVRGIDPEE GRFNNLRLIVERNNLYVTGFVNRTNNVFYRFADFS HVTFPGTTAVTLSGDSSYTTLQRVAGISRTGMQINR HSLTTSYLDLMSHSGTSLTQSVARAMLRFVTVTAE ALRFRQIQRGFRTTLDDLSGRSYVMTAEDVDLTLN WGRLSSVLPDYHGQDSVRVGRISFGSINAILGSVALI LNSHHHAS |
| SEQ ID NO: 112 | multivalent CD20-binding molecule component 66 | QVQLVQSGAEVKKPGSSVKVSCKASGYAFSYSWIN WVRQAPGQGLEWMGRIFPGDGDTDYNGKFKGRVT ITADKSTSTAYMELSSLRSEDTAVYYCARNVFDGY WLVYWGQGTLVTVSSGGGGSDIVMTQTPLSLPVTP GEPASISCRSSKSLLHSNGITYLYWYLQKPGQSPQLL IYQMSNLVSGVPDRFSGSGSGTDFTLKISRVEAEDV GVYYCAQNLELPYTFGGGTKVEIKEFPKPSTPPGSS GGAPKEFTLDFSTAKTYVDSLNVIRSAIGTPLQTISS GGTSLLMIDSGSGDNLFAVDVRGIDPEEGRFNNLR LIVERNNLYVTGFVNRTNNVFYRFADFSHVTFPGTT AVTLSGDSSYTTLQRVAGISRTGMQINRHSLTTSYL DLMSHSGTSLTQSVARAMLRFVTVTAEALRFRQIQ RGFRTTLDDLSGRSYVMTAEDVDLTLNWGRLSSVL PDYHGQDSVRVGRISFGSINAILGSVALILNSHHHAS RVAR |
| SEQ ID NO: 113 | multivalent CD20-binding molecule component 67 | QVQLVQSGAEVKKPGSSVKVSCKASGYAFSYSWIN WVRQAPGQGLEWMGRIFPGDGDTDYNGKFKGRVT ITADKSTSTAYMELSSLRSEDTAVYYCARNVFDGY WLVYWGQGTLVTVSSGSTSGSGKPGSGEGSDIVMT QTPLSLPVTPGEPASISCRSSKSLLHSNGITYLYWYL QKPGQSPQLLIYQMSNLVSGVPDRFSGSGSGTDFTL KISRVEAEDVGVYYCAQNLELPYTFGGGTKVEIKG GGGCGGKEFTLDFSTAKTYVDSLNVIRSAIGTPLQTI SSGGTSLLMIDSGSGDNLFAVDVRGIDPEEGRFNNL RLIVERNNLYVTGFVNRTNNVFYRFADFSHVTFPGT TAVTLSGDSSYTTLQRVAGISRTGMQINRHSLTTSY LDLMSHSGTSLTQSVARAMLRFVTVTAEALRFRQI QRGFRTTLDDLSGRSYVMTAEDVDLTLNWGRLSSV LPDYHGQDSVRVGRISFGSINAILGSVALILNSHHHA S |
| SEQ ID NO: 114 | multivalent CD20-binding molecule component 68 | DIVMTQTPLSLPVTPGEPASISCRSSKSLLHSNGITYL YWYLQKPGQSPQLLIYQMSNLVSGVPDRFSGSGSG TDFTLKISRVEAEDVGVYYCAQNLELPYTFGGGTK VEIKGSTSGSGKPGSGEGSQVQLVQSGAEVKKPGSS VKVSCKASGYAFSYSWINWVRQAPGQGLEWMGRI FPGDGDTDYNGKFKGRVTITADKSTSTAYMELSSL RSEDTAVYYCARNVFDGYWLVYWGQGTLVTVSSE FPKPSTPPGSSGGAPKEFTLDFSTAKTYVDSLNVIRS AIGTPLQTISSGGTSLLMIDSGSGDNLFAVDVRGIDP EEGRFNNLRLIVERNNLYVTGFVNRTNNVFYRFAD FSHVTFPGTTAVTLSGDSSYTTLQRVAGISRTGMQI NRHSLTTSYLDLMSHSGTSLTQSVARAMLRFVTVT AEALRFRQIQRGFRTTLDDLSGRSYVMTAEDVDLT LNWGRLSSVLPDYHGQDSVRVGRISFGSINAILGSV ALILNSHHHASRVAR |
| SEQ ID NO: 115 | multivalent CD20-binding molecule component 69 | DIVMTQTPLSLPVTPGEPASISCRSSKSLLHSNGITYL YWYLQKPGQSPQLLIYQMSNLVSGVPDRFSGSGSG TDFTLKISRVEAEDVGVYYCAQNLELPYTFGGGTK VEIKGGGGSQVQLVQSGAEVKKPGSSVKVSCKASG YAFSYSWINWVRQAPGQGLEWMGRIFPGDGDTDY NGKFKGRVTITADKSTSTAYMELSSLRSEDTAVYY CARNVFDGYWLVYWGQGTLVTVSSEFPKPSTPPGS SGGAPGILGFVPTLKEFTLDFSTAKTYVDSLNVIRSA IGTPLQTISSGGTSLLMIDSGSGDNLFAVDVRGIDPE EGRFNNLRLIVERNNLYVTGFVNRTNNVFYRFADFS HVTFPGTTAVTLSGDSSYTTLQRVAGISRTGMQINR HSLTTSYLDLMSHSGTSLTQSVARAMLRFVTVTAE ALRFRQIQRGFRTTLDDLSGRSYVMTAEDVDLTLN WGRLSSVLPDYHGQDSVRVGRISFGSINAILGSVALI LNSHHHASRVARKDEL |
| SEQ ID NO: 116 | multivalent CD20-binding molecule component 70 | DIVMTQTPLSLPVTPGEPASISCRSSKSLLHSNGITYL YWYLQKPGQSPQLLIYQMSNLVSGVPDRFSGSGSG TDFTLKISRVEAEDVGVYYCAQNLELPYTFGGGTK |

| Sequence Listing | | |
|---|---|---|
| ID Number | Text Description | Biological Sequence |
| | | VEIKGSTSGSGKPGSGEGSQVQLVQSGAEVKKPGSS<br>VKVSCKASGYAFSYSWINWVRQAPGQGLEWMGRI<br>FPGDGDTDYNGKFKGRVTITADKSTSTAYMELSSL<br>RSEDTAVYYCARNVFDGYWLVYWGQGTLVTVSSE<br>FPKPSTPPGSSGGAPGILGFVFTLKEFTLDFSTAKTY<br>VDSLNVIRSAIGTPLQTISSGGTSLLMIDSGSGDNLF<br>AVDVRGIDPEEGRFNNLRLIVERNNLYVTGFVNRTN<br>NVFYRFADFSHVTFPGTTAVTLSGDSSYTTLQRVAG<br>ISRTGMQINRHSLTTSYLDLMSHSGTSLTQSVARAM<br>LRFVTVTAEALRFQIQRGFRTTLDDLSGRSYVMTA<br>EDVDLTLNWGRLSSVLPDYHGQDSVRVGRISFGSIN<br>AILGSVALILNSHHHASRVAR |
| SEQ ID NO: 117 | multivalent CD20-<br>binding molecule<br>component 71 | DIVMTQTPLSLPVTPGEPASISCRSSKSLLHSNGITYL<br>YWYLQKPGQSPQLLIYQMSNLVSGVPDRFSGSGSG<br>TDFTLKISRVEAEDVGVYYCAQNLELPYTFGGGTK<br>VEIKGSTSGSGKPGSGEGSQVQLVQSGAEVKKPGSS<br>VKVSCKASGYAFSYSWINWVRQAPGQGLEWMGRI<br>FPGDGDTDYNGKFKGRVTITADKSTSTAYMELSSL<br>RSEDTAVYYCARNVFDGYWLVYWGQGTLVTVSSE<br>FPKPSTPPGSSGGAPGILGFVFTLKEFTLDFSTAKTY<br>VDSLNVIRSAIGTPLQTISSGGTSLLMIDSGSGDNLF<br>AVDVRGIDPEEGRFNNLRLIVERNNLYVTGFVNRTN<br>NVFYRFADFSHVTFPGTTAVTLSGDSSYTTLQRVAG<br>ISRTGMQINRHSLTTSYLDLMSHSGTSLTQSVARAM<br>LRFVTVTAEALRFQIQRGFRTTLDDLSGRSYVMTA<br>EDVDLTLNWGRLSSVLPDYHGQDSVRVGRISFGSIN<br>AILGSVALILNSHHHASRVAR |
| SEQ ID NO: 118 | multivalent CD20-<br>binding molecule<br>component 72 | DIVMTQTPLSLPVTPGEPASISCRSSKSLLHSNGITYL<br>YWYLQKPGQSPQLLIYQMSNLVSGVPDRFSGSGSG<br>TDFTLKISRVEAEDVGVYYCAQNLELPYTFGGGTK<br>VEIKGGGGSQVQLVQSGAEVKKPGSSVKVSCKASG<br>YAFSYSWINWVRQAPGQGLEWMGRIFPGDGDTDY<br>NGKFKGRVTITADKSTSTAYMELSSLRSEDTAVYY<br>CARNVFDGYWLVYWGQGTLVTVSSEFPKPSTPPGS<br>SGGAPKEFTLDFSTAKTYVDSLNVIRSAIGTPLQTISS<br>GGTSLLMIDSGSGDNLFAVDVRGIDPEEGRFNNLR<br>LIVERNNLYVTGFVNRTNNVFYRFADFSHVTFPGTT<br>AVTLSGDSSYTTLQRVAGISRTGMQINRHSLTTSYL<br>DLMSHSGTSLTQSVARAMLRFVTVTAEALRFRQIQ<br>RGFRTTLDDLSGRSYVMTAEDVDLTLNWGRLSSVL<br>PDYHGQDSVRVGRISFGSINAILGSVALILNSHHHAS<br>RVAR |
| SEQ ID NO: 119 | multivalent CD20-<br>binding molecule<br>component 73 | DIVMTQTPLSLPVTPGEPASISCRSSKSLLHSNGITYL<br>YWYLQKPGQSPQLLIYQMSNLVSGVPDRFSGSGSG<br>TDFTLKISRVEAEDVGVYYCAQNLELPYTFGGGTK<br>VEIKGGgGSGGGGSGGGGSGGGGSGGGGSQVQLV<br>QSGAEVKKPGSSVKVSCKASGYAFSYSWINWVRQ<br>APGQGLEWMGRIFPGDGDTDYNGKFKGRVTITADK<br>STSTAYMELSSLRSEDTAVYYCARNVFDGYWLVY<br>WGQGTLVTVSSGGGGSGGKEFTLDFSTAKTYVDSL<br>NVIRSAIGTPLQTISSGGTSLLMIDSGSGDNLFAVDV<br>RGIDPEEGRFNNLRLIVERNNLYVTGFVNRTNNVFY<br>RFADFSHVTFPGTTAVTLSGDSSYTTLQRVAGISRT<br>GMQINRHSLTTSYLDLMSHSGTSLTQSVARAMLRF<br>VTVTAEALRFRQIQRGFRTTLDDLSGRSYVMTAED<br>VDLTLNWGRLSSVLPDYHGQDSVRVGRISFGSINAI<br>LGSVALILNSHHHASAVAA |
| SEQ ID NO: 120 | multivalent CD20-<br>binding molecule<br>component 74 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARE<br>FPKPSTPPGSSGGAPQAYLQQSGAELVRPGASVKMS<br>CKASGYTFTSYNMHWVKQTPRQGLEWIGAIYPGN<br>GDTSYNQKFKGKATLTVDKSSSTAYMQLSSLTSED<br>SAVYFCARVVYYSNSYWYFDVWGTGTTVTVSGGG<br>GSGGGGSGGGGSGGGGSGGGGSQIVLSQSPAILSAS |

| ID Number | Text Description | Biological Sequence |
|---|---|---|
| | | PGEKVTMTCRASSSVSYMHWYQQKPGSSPKPWIYA PSNLASGVPARFSGSGSGTSYSLTISRVEAEDAATY YCQQWSFNPPTFGAGTKLELKS |
| SEQ ID NO: 121 | multivalent CD20-binding molecule component 75 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARE FPKPSTPPGSSGGAPQAYLQQSGAELVRPGASVKMS CKASGYTFTSYNMHWVKQTPRQGLEWIGAIYPGN GDTSYNQKFKGKATLTVDKSSSTAYMQLSSLTSED SAVYFCARVVYYSNSYWYFDVWGTGTTVTVSGST SGSGKPGSGEGSQIVLSQSPAILSASPGEKVTMTCRA SSSVSYMHWYQQKPGSSPKPWIYAPSNLASGVPAR FSGSGSGTSYSLTISRVEAEDAATYYCQQWSFNPPT FGAGTKLELKS |
| SEQ ID NO: 122 | multivalent CD20-binding molecule component 76 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARE FPKPSTPPGSSGGAPQAYLQQSGAELVRPGASVKMS CKASGYTFTSYNMHWVKQTPRQGLEWIGAIYPGN GDTSYNQKFKGKATLTVDKSSSTAYMQLSSLTSED SAVYFCARVVYYSNSYWYFDVWGTGTTVTVSGGG GSQIVLSQSPAILSASPGEKVTMTCRASSSVSYMHW YQQKPGSSPKPWIYAPSNLASGVPARFSGSGSGTSY SLTISRVEAEDAATYYCQQWSFNPPTFGAGTKLELK S |
| SEQ ID NO: 123 | multivalent CD20-binding molecule component 77 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARG GGGSGGQAYLQQSGAELVRPGASVKMSCKASGYT FTSYNMHWVKQTPRQGLEWIGAIYPGNGDTSYNQ KFKGKATLTVDKSSSTAYMQLSSLTSEDSAVYFCA RVVYYSNSYWYFDVWGTGTTVTVSGGGGSGGGGS GGGGSGGGGSGGGGSQIVLSQSPAILSASPGEKVTM TCRASSSVSYMHWYQQKPGSSPKPWIYAPSNLASG VPARFSGSGSGTSYSLTISRVEAEDAATYYCQQWSF NPPTFGAGTKLELKS |
| SEQ ID NO: 124 | multivalent CD20-binding molecule component 78 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARG GGGSGGQAYLQQSGAELVRPGASVKMSCKASGYT FTSYNMHWVKQTPRQGLEWIGAIYPGNGDTSYNQ KFKGKATLTVDKSSSTAYMQLSSLTSEDSAVYFCA RVVYYSNSYWYFDVWGTGTTVTVSGSTSGSGKPG SGEGSQIVLSQSPAILSASPGEKVTMTCRASSSVSYM HWYQQKPGSSPKPWIYAPSNLASGVPARFSGSGSG TSYSLTISRVEAEDAATYYCQQWSFNPPTFGAGTKL ELKS |
| SEQ ID NO: 125 | multivalent CD20-binding molecule component 79 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARE |

| ID Number | Text Description | Biological Sequence |
|---|---|---|
| | | FPKPSTPPGSSGGAPQVQLQQPGAELVRPGASVKMS<br>FTSYNMHWVKQTPRQGLEWIGAIYPGNGDTSYNQ<br>KFKGKATLTVDKSSSTAYMQLSSLTSEDSAVYFCA<br>VYYCARSNYYSNSYWFFDVWGAGTTVTVSGGG<br>GSGGGGSGGGGSGGGGSGGGGSQIVLSQSPAILSAS<br>PGEKVTMTCRASSSVSYMHWYQQKPGSSPKPWIYA<br>TSNLASGVPARFSGSGSGTSYSLTISRVEAEDAATY<br>YCQQWSFNPPTFGAGTKLELK |
| SEQ ID NO: 126 | multivalent CD20-<br>binding molecule<br>component 80 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHASRVARE<br>FPKPSTPPGSSGGAPQAYLQQSGAELVRPGASVKMS<br>CKASGYTFTSYNMHWVKQTPRQGLEWIGAIYPGNG<br>DTSYNQKFKGKATLTVDKSSSTAYMQLSSLTSEDSA<br>VYYCARSNYYGSSYVWFFDVWGAGTTVTVSSGST<br>SGSGKPGSGEGGSQIVLSQSPAILSASPGEKVTMTCRA<br>SSSVSYMHWYQQKPGSSPKPWIYAPSNLASGVPAR<br>FSGSGSGTSYSLTISRVEAEDAATYYCQQWSFNPPTF<br>GAGTKLELK |
| SEQ ID NO: 127 | multivalent CD20-<br>binding molecule<br>component 81 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHASRVARE<br>FPKPSTPPGSSGGAPQVQLQQPGAELVRPGASVKMS<br>CKTSGYTFTSYNMHWVKQTPRQGLEWIGAIYPGNG<br>DTSFNQKFKGKATLTADKSSTVYMQLSSLTSEDSA<br>VYYCARSNYYSNSYWFFDVWGAGTTVTVSSGGG<br>GSQIVLSQSPAILSASPGEKVTMTCRASSSVSYMHW<br>YQQKPGSSPKPWIYATSNLASGVPARFSGSGSGTSY<br>SLTISRVEAEDAATYYCQQWSFNPPTFGAGTKLELK |
| SEQ ID NO: 128 | multivalent CD20-<br>binding molecule<br>component 82 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHASRVARG<br>GGGSGGQAYLQQSGAELVRPGASVKMSCKASGYT<br>FTSYNMHWVKQTPRQGLEWIGAIYPGNGDTSYNQK<br>FKGKATLTVDKSSSTAYMQLSSLTSEDSAVYFCAR<br>SNYYGSSYVWFFDVWGAGTTVTVSSGGGGSGGGG<br>SGGGGSGGGGSGGGGSQIVLSQSPTILSASPGEKVT<br>MTCRASSSVSYMHWYQQKPGSSPKPWIYAPSNLAS<br>GVPARFSGSGSGTSYSLTISRVEAEDAATYYCQQWI<br>SNPPTFGAGTKLELKS |
| SEQ ID NO: 129 | multivalent CD20-<br>binding molecule<br>component 83 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHASRVARG<br>GGGSGGQAYLQQSGAELVRPGASVKMSCKASGYT<br>FTSYNMHWVKQTPRQGLEWIGAIYPGNGDTSYNQK<br>FKGKATLTVDKSSSTAYMQLSSLTSEDSAVYFCAR<br>SNYYGSSYWFFDVWGAGTTVTVSGSTSGSGKPG<br>SGEGSQIVLSQSPAILSASPGEKVTMTCRASSSVSYM<br>DWYQQKPGSSPKPWIYAPSNLASGVPARFSGSGSG<br>TSYSLTISRVEAEDAATYYCQQWSFNPPTFGAGTKL<br>ELK |
| SEQ ID NO: 130 | multivalent CD20-<br>binding molecule<br>component 84 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS |

| Sequence Listing | | |
|---|---|---|
| ID Number | Text Description | Biological Sequence |
| | | GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHASRVARG<br>GGGSGGQVQLQQPGAELVKPGASVKMSCKTSGYT<br>FTSYNMHWVKQTPRQGLEWIGAIYPGNGDTSYNQK<br>FKGKATLTADKSSSTAVYMQLSSLTSEDSAVYYCAR<br>SNYYGSSYWFFDVWGAGTTVTVSSGGGGSQIVLS<br>QSPTILSASPGEKVTMTCRASSSVSYMHWYQQKPG<br>SSPKPWIYATSNLASGVPARFSGSGSGTSYSLTISRV<br>EAEDAATYYCQQWSFNPPTFGAGTKLELK |
| SEQ ID NO: 131 | multivalent CD20-<br>binding molecule<br>component 85 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHASEFPKP<br>STPPGSSGGAPQVQLQQPGAELVKPGASVKMSCKT<br>SGYTFTSYNVHWVKQTPGQGLEWIGAIYPGNDTS<br>FNQKFKGKATLTADKSSSTVYMQLSSLTSEDSAVY<br>YCARSNYYGSSYWFFDVWGAGTTVTVSSGGGGS<br>GGGGCGGGGCGGGGSGGGGSQIVLSQSPTILSASPG<br>EKVTMTCRASSSVSYMHWYQQKPGSSPKPWIYATS<br>NLASGVPARFSGSGSGTSYSLTISRVEAEDAATYYC<br>QQWTSNPPTFGAGTKLELK |
| SEQ ID NO: 132 | multivalent CD20-<br>binding molecule<br>component 86 | KEFTLDFSTAKTYVDSLNVIRSAIGTPLQTISSGGTSL<br>LMIDNLVPMVATVVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHASRVARE<br>FPKPSTPPGSSGGAPQVQLQQPGAELVKPGASVKMS<br>CKTSGYTFTSYNVHWVKQTPGQGLEWIGAIYPGNG<br>DTSFNQKFKGKATLTADKSSSTVYMQLSSLTSEDSA<br>VYYCARSNYYGSSYVWFTDVWGAGTIVTVSSGST<br>SGSGKPGSGEGSQIVLSQSPTILSASPGEKVFMTCRA<br>SSSVSYMDWYQQKPGSSPKPWIYATSNLASGVPAR<br>FSGSGSGTSYSLTISRVEAEDAATYYCQQWTSNPPTF<br>GAGTKLELK |
| SEQ ID NO: 133 | multivalent CD20-<br>binding molecule<br>component 87 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHASVARE<br>FPKPSTPPGSSGGAPQVQLQQPGAELVKPGASVKMS<br>CKTSGYTFTSYNVHWVKQTPGQGLEWIGAIYPGNG<br>DTSFNQKFKGKATLTADKSSSTVYMQLSSLTSEDSA<br>VYYCARSNYYGSSYWFFDVWGAGTTVTVSSGGG<br>GSGGGGCGGGGCGGGGSGGGGSQIVLSQSPTILSAS<br>PGEKVTMTCRASSSVSYMHWYQQKPGSSPKPWIYA<br>TSNLASGVPARFSGSGSGTSYSLTISRVEAEDAATY<br>YCQQWTSNPPTFGAGTKLELK |
| SEQ ID NO: 134 | multivalent CD20-<br>binding molecule<br>component 88 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHASVARE<br>FPKPSTPPGSSGGAPQVQLQQPGAELVKPGASVKMS<br>CKTSGYTFTSYNVHWVKQTPGQGLEWIGAIYPGNG<br>DTSFNQKFKGKATLTADKSSSTVYMQLSSLTSEDSA<br>VYYCARSNYYGSSYWFFDVWGAGTTVTVSSGST<br>SGSGKPGSGEGSQIVLSQSPTILSASPGEKVTMTCRA<br>SSSVSYMHWYQQKPGSSPKPWIYATSNLASGVPAR<br>FSGSGSGTSYSLTISRVEAEDAATYYCQQWTSNPPTF<br>GAGTKLELKDEL |

Sequence Listing

| ID Number | Text Description | Biological Sequence |
|---|---|---|
| SEQ ID NO: 135 | multivalent CD20-binding molecule component 89 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHASVARE FPKPSTPPGSSGGAPQVQLQQPGAELVKPGASVKMS CKTSGYTFTSYNVHWVKQTPGQGLEWIGAIYPGNG DTSFNQKFKGKATLTADKSSSTVYMQLSSLTSEDSA VYYCARSNYYGSSYWFFDVWGAGTTVTVSSGGG GSQIVLSQSPTILSASPGEKVTMTCRASSSVSYMHW YQQKPGSSPKPWIYATSNLASGVPARFSGSGSGTSY SLTISRVEAEDAATYYCQQWTSNPPTFGAGTKLELK DEL |
| SEQ ID NO: 136 | multivalent CD20-binding molecule component 90 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHASRVARG GGGSGGQVQLQQPGAELVKPGASVKMSCKTSGYT FTSYNMHWVKQTPRQGLEWIGAIYPGNGDTSYNQK FKGKATLTADKSSSTAVYMQLSSLTSEDSAVYYCAR SNYYGSSYWFFDVWGAGTTVTVSSGGGGSGGGGG SGGGGSGGGGSGGGGSQIVLSQSPTILSASPGEKVT MTCRASSSVSYMHWYQQKPGSSPKPWIYATSNLAS GVPARFSGSGSGTSYSLTISRVEAEDAATYYCQQWI SNPPTFGAGTKLELKDEL |
| SEQ ID NO: 137 | multivalent CD20-binding molecule component 91 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHASRVARG GGGSGGQVQLQQPGAELVKPGASVKMSCKTSGYT FTSYNMHWVKQTPRQGLEWIGAIYPGNGDTSYNQK FKGKATLTADKSSSTAVYMQLSSLTSEDSAVYYCAR SNYYGSSYWFFDVWGAGTTVTVSSGSTSGSGKPG SGESQIVLSQSPTILSASPGEKVTMTCRASSSVSYM DWYQQKPGSSPKPWIYATSNLASGVPARFSGSGSG TSYSLTISRVEAEDAATYYCQQWTSNPPTFGAGTKL ELKDEL |
| SEQ ID NO: 138 | multivalent CD20-binding molecule component 92 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHASRVARG GGGSGGQVQLQQPGAELVKPGASVKMSCKTSGYT FTSYNMHWVKQTPRQGLEWIGAIYPGNGDTSYNQK FKGKATLTADKSSSTAVYMQLSSLTSEDSAVYYCAR SNYYGSSYWFFDVWGAGTTVTVSSGGGGSQIVLS QSPTILSASPGEKVTMTCRASSSVSYMHWYQQKPG SSPKPWIYATSNLASGVPARFSGSGSGTSYSLTISRV EAEDAATYYCQQWSFNPPTFGAGTKLELK |
| SEQ ID NO: 139 | multivalent CD20-binding molecule component 93 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHASEFPKP STPPGSSGGAPQVQLQQPGAELVKPGASVKMSCKT SGYTFTSYNVHWVKQTPGQGLEWIGAIYPGNDTS FNQKFKGKATLTADKSSSTVYMQLSSLTSEDSAVY YCARSNYYGSSYWFFDVWGAGTTVTVSSGGGGS |

| ID Number | Text Description | Biological Sequence |
|---|---|---|
| | | GGGGSGGGGSGGGGSGGGGSQIVLSQSPTILSASPG<br>EKVTMTCRASSSVSYMHWYQQKPGSSPKPWIYATS<br>NLASGVPARFSGSGSGTSYSLTISRVEAEDAATYYC<br>QQWTSNPPTFGAGTKLELKDEL |
| SEQ ID NO: 140 | multivalent CD20-<br>binding molecule<br>component 94 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASVARE<br>FPKPSTPPGSSGGAPQVQLQQPGAELVKPGASVKMS<br>CKTSGYTFTSYNVHWVKQTPGQGLEWIGAIYPGNG<br>DTSFNQKFKGKATLTADKSSSTVYMQLSSLTSEDSA<br>VYYCARSNYYGSSYWFFDVWGAGTTVTVSSGST<br>SGSGKPGSGEGSQIVLSQSPTILSASPGEKVTMTCRA<br>SSSVSYMHWYQQKPGSSPKPWIYATSNLASGVPAR<br>FSGSGSGTSYSLTISRVEAEDAATYYCQQWTSNPPTF<br>GAGTKLELKDEL |
| SEQ ID NO: 141 | multivalent CD20-<br>binding molecule<br>component 95 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARE<br>FPKPSTPPGSSGGAPQVQLVQSGAEVKKPGSSVKVS<br>CKASGYAFSYSWINWVRQAPGQGLEWMGRIFPGD<br>GDTDYNGKFKGRVTITADKSTSTAYMELSSLRSEDT<br>AVYYCARNFDGYWLVYWGQGTLVTVSSGSTSGS<br>GKPGSGEGSDIVMTQTPLSLPVTPGEPASISCRSSKS<br>LLHSNGITYLYWYLQKPGQSPQLLIYQMSNLVSGVP<br>DRFSGSGSGTDFTLKISRVEAEDVGVYYCAQNLELP<br>YTFGGGTKVEIK |
| SEQ ID NO: 142 | multivalent CD20-<br>binding molecule<br>component 96 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARG<br>GGGSGGQVQLQQPGAEVKKPGSSVKVSCKASGYA<br>FSYSWINWVRQAPGQGLEWMGRIFPGDGDTDYNG<br>KFKGRVTITADKSTSTAYMELSSLRSEDTAVYYCAR<br>NVFDGYWLVYWGQGTLVTVSSGGGGSDIVMTQTP<br>LSLPVTPGEPASISCRSSKSLLHSNGITYLYWYLQKP<br>GQSPQLLIYQMSNLVSGVPDRFSGSGSGTDFTLKISR<br>VEAEDVGVYYCAQNLELPYTFGGGTKVEIK |
| SEQ ID NO: 143 | multivalent CD20-<br>binding molecule<br>component 97 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARE<br>FPKPSTPPGSSGGAPQVQLVQSGAEVKKPGSSVKVS<br>CKASGYAFSYSWINWVRQAPGQGLEWMGRIFPGD<br>GDTDYNGKFKGRVTITADKSTSTAYMELSSLRSEDT<br>AVYYCARNVFDGYWLVYWGQGTLVTVSSGGGGS<br>GGGGSGGGGSGGGGSGGGGSDIVMTQTPLSLPVTP<br>GEPASISCRSSKSLLHSNGITYLYWYLQKPGQSPQLL<br>IYQMSNLVSGVPDRFSGSGSGTDFTLKISRVEAEDV<br>GVYYCAQNLELPYTFGGGTKVEIK |
| SEQ ID NO: 144 | multivalent CD20-<br>binding molecule<br>component 98 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARE |

| Sequence Listing | | |
|---|---|---|
| ID Number | Text Description | Biological Sequence |
| | | FPKPSTPPGSSGGAPQVQLQQPGAEVKKPGSSVKVS<br>CKASGYAFSYSWINWVRQAPGQGLEWMGRIFPGD<br>GDTDYNGKFKGRVTITADKSTSTAYMELSSLRSEDT<br>AVYYCARNVFDGYWLVYWGQGTLVTVSSGGGGS<br>DIVMTQTPLSLPVTPGEPASISCRSSKSLLHSSNGITYL<br>YWYLQKPGQSPQLLIYQMSNLVSGVPDRFSGSGSG<br>TDFTLKISRVEAEDVGVYYCAQNLELPYTFGGGTK<br>VEIK |
| SEQ ID NO: 145 | multivalent CD20-<br>binding molecule<br>component 99 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARE<br>FPKPSTPPGSSGGAPQVQLQQPGAEVKKPGSSVKVS<br>CKASGYAFSYSWINWVRQAPGQGLEWMGRIFPGD<br>GDTDYNGKFKGRVTITADKSTSTAYMELSSLRSEDT<br>AVYYCARNVFDGYWLVYWGQGTLVTVSSGSTSGS<br>GKPPGSGEGSDIVMTQTPLSLPVTPGEPASISCRSSKS<br>LLHSSNGITYLYWYLQKPGQSPQLLIYQMSNLVSGVP<br>DRFSGSGSGTDFTLKISRVEAEDVGVYYCAQNLELP<br>YTFGGGTKVEIK |
| SEQ ID NO: 146 | multivalent CD20-<br>binding molecule<br>component 100 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARE<br>FPKPSTPPGSSGGAPDIVMTQTPLSLPVTPGEPASISC<br>RSSKSLLHSNGITYLYWYLQKPGQSPQLLIYQMSNL<br>VSGVPDRFSGSGSGTDFTLKISRVEAEDVGVYYCAQ<br>VQSGAEVKKPGSSVKVSCKASGYAFSYSWINWVR<br>QAPGQGLEWMGRIFPGDGDTDYNGKFKGRVTITAD<br>KSTSTAYMELSSLRSEDTAVYYCARNVFDGYWLV<br>YWGQGTLVTVSS |
| SEQ ID NO: 147 | multivalent CD20-<br>binding molecule<br>component 101 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARG<br>GGGSGGDIVMTQTPLSLPVTPGEPASISCRSSKSLLH<br>SNGITYLYWYLQKPGQSPQLLIYQMSNLVSGVPDRF<br>SGSGSGTDFTLKISRVEAEDVGVYYCAQNLELPYTF<br>GGGTKVEIKGGGGSGGGGSGGGGSGGGGSGGGS<br>QVQSGAEVKKPGSSVKVSCKASGYAFSYSWIN<br>WVRQAPGQGLEWMGRIFPGDGDTDYNGKFKGRVT<br>ITADKSTSTAYMELSSLRSEDTAVYYCARNVFDGY<br>WLVYWGQGTLVTVSS |
| SEQ ID NO: 148 | multivalent CD20-<br>binding molecule<br>component 102 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARG<br>GGGSGGDIVMTQTPLSLPVTPGEPASISCRSSKSLLH<br>SNGITYLYWYLQKPGQSPQLLIYQMSNLVSGVPDRF<br>SGSGSGTDFTLKISRVEAEDVGVYYCAQNLELPYTF<br>GGGTKVEIKGGGGSQVQLVQSGAEVKKPGSSVKVS<br>CKASGYAFSYSWINWVRQAPGQGLEWMGRIFPGD<br>GDTDYNGKFKGRVTITADKSTSTAYMELSSLRSEDT<br>AVYYCARNVFDGYWLVYWGQGTLVTVSS |
| SEQ ID NO: 149 | multivalent CD20-<br>binding molecule<br>component 103 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH |

| ID Number | Text Description | Biological Sequence |
|---|---|---|
| | | SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASEFPKP<br>STPPGSSGGAPDIVMTQTPLSLPVTPGEPASISCRSSK<br>SLLHSNGITYLYWYLQKPGQSPQLLIYQMSNLVSGV<br>DRFSGSGSGTDFTLKISRVEAEDVGVYYCAQNLEL<br>PYTFGGGTKVEIKGSTSGSGKPGSGEGSQVQLVQSG<br>AEVKKPGSSVKVSCKASGYAFSYSWINWVRQAPG<br>QGLEWMGRIFPGDGDTDYNGKFKGRVTITADKSTS<br>TAYMELSSLRSEDTAVYYCARNVFDGYWLVYWGQ<br>GTLVTVSS |
| SEQ ID NO: 150 | multivalent CD20-binding molecule component 104 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARE<br>FPKPSTPPGSSGGAPDIVMTQTPLSLPVTPGEPASISC<br>RSSKSLLHSNGITYLYWYLQKPGQSPQLLIYQMSNL<br>VSGVPDRFSGSGSGTDFTLKISRVEAEDVGVYYCAQ<br>NLELPYTFGGGTKVEIKGSTSGSGKPGSGEGSQVQL<br>VQSGAEVKKPGSSVKVSCKASGYAFSYSWINWVR<br>QAPGQGLEWMGRIFPGDGDTDYNGKFKGRVTITAD<br>KSTSTAYMELSSLRSEDTAVYYCARNVFDGYWLV<br>YWGQGTLVTVSS |
| SEQ ID NO: 151 | multivalent CD20-binding molecule component 105 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASEFPKP<br>STPPGSSGGAPDIVMTQTPLSLPVTPGEPASISCRSSK<br>SLLHSNGITYLYWYLQKPGQSPQLLIYQMSNLVSGV<br>PDRFSGSGSGTDFTLKISRVEAEDVGVYYCAQNLEL<br>PYTFGGGTKVEIKGSTSGSGKPGSGEGSQVQLVQSG<br>AEVKKPGSSVKVSCKASGYAFSYSWINWVRQAPG<br>QGLEWMGRIFPGDGDTDYNGKFKGRVTITADKSTS<br>TAYMELSSLRSEDTAVYYCARNVFDGYWLVYWGQ<br>GTLVTVSS |
| SEQ ID NO: 152 | multivalent CD20-binding molecule component 106 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARE<br>FPKPSTPPGSSGGAPQIVLSQSPAILSASPGEKVTMT<br>CRASSSVSYMHWYQQKPGSSPKPWIYAPSNLASGV<br>PARFSGSGSGTSYSLTISRVEAEDAATYYCQQWSFN<br>PPTFGAGTKLELKSGSTSGSGKPGSGEGSQAYLQQS<br>GAELVRPGASVKMSCKASGYTFTSYNMHWVKQTP<br>RQGLEWIGAIYPGNGDTSYNQKFKGKATLTVDKSS<br>STAYMQLSSLTSEDAVYFCARVVYYSNSYWYFDV<br>WGTGTTVTVSS |
| SEQ ID NO: 153 | multivalent CD20-binding molecule component 107 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNSHHHASRVARE<br>FPKPSTPPGSSGGAPQIVLSQSPAILSASPGEKVTMT<br>CRASSSVSYMHWYQQKPGSSPKPWIYAPSNLASGV<br>PARFSGSGSGTSYSLTISRVEAEDAATYYCQQWSFN<br>PPTFGAGTKLELKSGGGGQAYLQQSGAELVRPGA<br>SVKMSCKASGYTFTSYNMHWVKQTPRQGLEWIGA<br>IYPGNGDTSYNQKFKGKATLTVDKSSSTAYMQLSS<br>LTSEDAVYFCARVVYYSNSYWYFDVWGTGTTVT<br>VS |

| | | Sequence Listing |
|---|---|---|
| ID Number | Text Description | Biological Sequence |
| SEQ ID NO: 154 | multivalent CD20-binding molecule component 108 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARE FPKPSTPPGSSGGAPQIVLSQSPAILSASPGEKVTMT CRASSSVSYMHWYQQKPGSSPKPWIYAPSNLASGV PARFSGSGSGTSYSLTISRVEAEDAATYYCQQWSFN PPTFGAGTKLELKSGSTSGSGKPGSGEGSQAYLQQS GAELVRPGASVKMSCKASGYTFTSYNMHWVKQTP RQGLEWIGAIYPGNGDTSYNQKFKGKATLTVDKSS STAYMQLSSLTSEDAVYFCARVVYYSNSYWYFDV WGTGTTVTVS |
| SEQ ID NO: 155 | multivalent CD20-binding molecule component 109 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARE FPKPSTPPGSSGGAPQIVLSQSPAILSASPGEKVTMT CRASSSVSYMHWYQQKPGSSPKPWIYAPSNLASGV PARFSGSGSGTSYSLTISRVEAEDAATYYCQQWSFN PPTFGAGTKLELKSGSTSGSGKPGSGEGSQAYLQQS GAELVRPGASVKMSCKASGYTFTSYNMHWVKQTP RQGLEWIGAIYPGNGDTSYNQKFKGKATLTVDKSS STAYMQLSSLTSEDAVYFCARVVYYSNSYWYFDV WGTGTTVTVS |
| SEQ ID NO: 156 | multivalent CD20-binding molecule component 110 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARG GGGSGGQIVLSQSPAILSASPGEKVTMTCRASSSVS YMHWYQQKPGSSPKPWIYAPSNLASGVPARFSGSG SGTSYSLTISRVEAEDAATYYCQQWSFNPPTFGAGT KLELKSGGGGSGGGGSGGGGSGGGGSGGGGSQAY LQQSGAELVRPGASVKMSCKASGYTFTSYNMHWV KQTPRQGLEWIGAIYPGNGDTSYNQKFKGKATLTV DKSSSTAYMQLSSLTSEDAVYFCARVVYYSNSYW YFDVWGTGTTVTVS |
| SEQ ID NO: 157 | multivalent CD20-binding molecule component 111 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVAAE FPKPSTPPGSSGGAPQIVLSQSPAILSASPGEKVTMT CRASSSVSYMHWYQQKPGSSPKPWIYAPSNLASGV PARFSGSGSGTSYSLTISRVEAEDAATYYCQQWSFN PPTFGAGTKLELKSGSTSGSGKPGSGEGSQAYLQQS GAELVRPGASVKMSCKASGYTFTSYNMHWVKQTP RQGLEWIGAIYPGNGDTSYNQKFKGKATLTVDKSS STAYMQLSSLTSEDAVYFCARVVYYSNSYWYFDV WGTGTTVTVS |
| SEQ ID NO: 158 | multivalent CD20-binding molecule component 112 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARE FPKPSTPPGSSGGAPEIVLTQSPATLSLSPGERATLSC RASQSVSSYLAWYQQKPGQAPRLLIYDASNRATGIP ARFSGSGSGTDFTLTISSLEPEDFAVYYCQQRSNWPI |

| ID Number | Text Description | Biological Sequence |
|---|---|---|
| | | TFGQGTRLEIKGSTSGSGKPGSGEGSEVQLVESGGG<br>LVQPGRSLRLSCAASGFTFNDYAMHWVRQAPGKG<br>LEWVSTISWNSGSIGYADSVKGRFTISRDNAKKSLY<br>LQMNSLRAEDTALYYCAKDIQYGNYYYGMDVWG<br>QGTTVTVSS |
| SEQ ID NO: 159 | multivalent CD20-<br>binding molecule<br>component 113 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFQIQRGFRTT<br>LDDLSGRSYVMTAEDVDLTLNWGRLSSVLPDYHG<br>QDSVRVGRISFGSINAILGSVALILNSHHHASRVARG<br>GGGSGGEIVLTQSPATLSLSGERATLSCRASQSVSS<br>YLAWYQQKPGQAPRLLIYDASNRATGIPARFSGSGS<br>GTDFTLTISSLEPEDFAVYYCQQRSNWPITFGQGTRL<br>EIKGGGGSGGGGSGGGGSGGGGSGGGGSEVQLVES<br>GGGLVQPGRSLRLSCAASGFTFNDYAMHWVRQAP<br>GKGLEWVSTISWNSGSIGYADSVKGRFTISRDNAKK<br>SLYLQMNSLRAEDTALYYCAKDIQYGNYYYGMDV<br>WGQGTTVTVSS |
| SEQ ID NO: 160 | multivalent CD20-<br>binding molecule<br>component 114 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFQIQRGFRTT<br>LDDLSGRSYVMTAEDVDLTLNWGRLSSVLPDYHG<br>QDSVRVGRISFGSINAILGSVALILNSHHHASRVARG<br>GGGSGGEIVLTQSPATLSLSGERATLSCRASQSVSS<br>YLAWYQQKPGQAPRLLIYDASNRATGIPARFSGSGS<br>GTDFTLTISSLEPEDFAVYYCQQRSNWPITFGQGTRL<br>EIKGGGGSGGGGSGGGGSGGGGSGGGGSEVQLVES<br>GGGLVQPGRSLRLSCAASGFTFNDYAMHWVRQAP<br>GKGLEWVSTISWNSGSIGYADSVKGRFTISRDNAKK<br>SLYLQMNSLRAEDTALYYCAKDIQYGNYYYGMDV<br>WGQGTTVTVSS |
| SEQ ID NO: 161 | multivalent CD20-<br>binding molecule<br>component 115 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFQIQRGFRTT<br>LDDLSGRSYVMTAEDVDLTLNWGRLSSVLPDYHG<br>QDSVRVGRISFGSINAILGSVALILNSHHHASGGGGS<br>GGEIVLTQSPATLSLSGERATLSCRASQSVSSYLA<br>WYQQKPGQAPRLLIYDASNRATGIPARFSGSGSGTD<br>FTLTISSLEPEDFAVYYCQQRSNWPITFGQGTRLEIK<br>GSTSGSGKPGSGEGSEVQLVESGGGLVQPGRSLRLS<br>CAASGFTFNDYAMHWVRQAPGKGLEWVSTISWNS<br>GSIGYADSVKGRFTISRDNAKKSLYLQMNSLRAEDT<br>ALYYCAKDIQYGNYYYGMDVWGQGTTVTVSS |
| SEQ ID NO: 162 | multivalent CD20-<br>binding molecule<br>component 116 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFQIQRGFRTT<br>LDDLSGRSYVMTAEDVDLTLNWGRLSSVLPDYHG<br>QDSVRVGRISFGSINAILGSVALILNSHHHASRVARG<br>GGGSGGEIVLTQSPATLSLSGERATLSCRASQSVSS<br>YLAWYQQKPGQAPRLLIYDASNRATGIPARFSGSGS<br>GTDFTLTISSLEPEDFAVYYCQQRSNWPITFGQGTRL<br>EIKGGGGSEVQLVESGGGLVQPGRSLRLSCAASGFT<br>FNDYAMHWVRQAPGKGLEWVSTISWNSGSIGYAD<br>SVKGRFTISRDNAKKSLYLQMNSLRAEDTALYYCA<br>KDIQYGNYYYGMDVWGQGTTVTVSS |
| SEQ ID NO: 163 | multivalent CD20-<br>binding molecule<br>component 117 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFQIQRGFRTT<br>LDDLSGRSYVMTAEDVDLTLNWGRLSSVLPDYHG<br>QDSVRVGRISFGSINAILGSVALILNSHHHASEFPKP |

-continued

| ID Number | Text Description | Biological Sequence |
|---|---|---|
| | | STPPGSSGGAPEIVLTQSPATLSLSPGERATLSCRAS QSVSSYLAWYQQKPGQAPRLLIYDASNRATGIPARF SGSGSGTDFTLTISSLEPEDFAVYYCQQRSNWPITFG QGTRLEIKGSTSGSGKPGSGEGSEVQLVESGGGLVQ PGRSLRLSCAASGFTFNDYAMHWVRQAPGKGLEW VSTISWNSGSIGYADSVKGRFTISRDNAKKSLYLQM NSLRAEDTALYYCAKDIQYGNYYYGMDVWGQGT TVTVSS |
| SEQ ID NO: 164 | multivalent CD20-binding molecule component 118 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFQIQRGFRTT LDDLSGRSYVMTAEDVDLTLNWGRLSSVLPDYHG QDSVRVGRISFGSINAILGSVALILNSHHASRVARE FPKPSTPPGSSGGAPQVQLQQPGAELVKPGASVKMS CKASGYTFTSYNMHWVKQTPGRGLEWIGAIYPGN GDTSYNQKFKGKATLTADKSSSTAYMQLSSLTSED SAVYYCARSTYYGGDWYFNVWGAGTTVTVSAGST SGSGKPGSGEGSTKGQIVLSQSPAILSASPGEKVTMT CRASSSVSYIHWFQQKPGSSPKPWIYATSNLASGVP VRFSGSGSGTSYSLTISRVEAEDAATYYCQQWTSNP PTFGGGTRLEIK |
| SEQ ID NO: 165 | multivalent CD20-binding molecule component 119 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFQIQRGFRTT LDDLSGRSYVMTAEDVDLTLNWGRLSSVLPDYHG QDSVRVGRISFGSINAILGSVALILNSHHASRVARG GGGSGGQVQLQQPGAELVKPGASVKMSCKASGYT FTSYNMHWVKQTPGRGLEWIGAIYPGNGDTSYNQ KFKGKATLTADKSSSTAYMQLSSLTSEDSAVYYCA RSTYYGGDWYFNVWGAGTTVTVSAGSTSGSGKPG SGEGSTKGQIVLSQSPAILSASPGEKVTMTCRASSSV SYIHWFQQKPGSSPKPWIYATSNLASGVPVRFSGSG SGTSYSLTISRVEAEDAATYYCQQWTSNPPTFGGGT KLEIK |
| SEQ ID NO: 166 | multivalent CD20-binding molecule component 120 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFQIQRGFRTT LDDLSGRSYVMTAEDVDLTLNWGRLSSVLPDYHG QDSVRVGRISFGSINAILGSVALILNSHHASRVARG GGGSGGQVQLQQPGAELVKPGASVKMSCKASGYT FTSYNMHWVKQTPGRGLEWIGAIYPGNGDTSYNQ KFKGKATLTADKSSSTAYMQLSSLTSEDSAVYYCA RSTYYGGDWYFNVWGAGTTVTVSAGSTSGSGKPG SGEGSTKGQIVLSQSPAILSASPGEKVTMTCRASSSV SYIHWFQQKPGSSPKPWIYATSNLASGVPVRFSGSG SGTSYSLTISRVEAEDAATYYCQQWTSNPPTFGGGT KLEIK |
| SEQ ID NO: 167 | multivalent CD20-binding molecule component 121 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFQIQRGFRTT LDDLSGRSYVMTAEDVDLTLNWGRLSSVLPDYHG QDSVRVGRISFGSINAILGSVALILNSHHASRVARG GGGSGGQVQLQQPGAELVKPGASVKMSCKASGYT FTSYNMHWVKQTPGRGLEWIGAIYPGNGDTSYNQ KFKGKATLTADKSSSTAYMQLSSLTSEDSAVYYCA RSTYYGGDWYFNVWGAGTTVTVSAGGGGSTKGQI VLSQSPAILSASPGEKVTMTCRASSSVSYIHWFQQK PGSSPKPWIYATSNLASGVPVRFSGSGSGTSYSLTIS RVEAEDAATYYCQQWTSNPPTFGGGTKLEIK |
| SEQ ID NO: 168 | multivalent CD20-binding molecule component 122 | KEFTLDFSTAKTYVDSLNVIRSAIGTPLQTISSGGTSL LMIDNLVPMVATVVDVRGIDPEEGRFNNLRLIVERN NLYVTGFVNRTNNVFYRFADFSHVTFPGTTAVTLS |

| Sequence Listing | | |
|---|---|---|
| ID Number | Text Description | Biological Sequence |
| | | GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARE FPKPSTPPGSSGGAPQVQLQQPGAELVKPGASVKMS CKASGYTFTSYNMHWVKQTPGRGLEWIGAIYPGN GDTSYNQKFKGKATLTADKSSSTAYMQLSSLTSED SAVYYCARSTYYGGDWYFNVWGAGTTVTVSAGG GGSGGGGSGGGGSGGGGSGGGGSTKGQIVLSQSPA ILSASPGEKVTMTCRASSSVSYIHWFQQKPGSSPKP WIYATSNLASGVPVRFSGSGSGTSYSLTISRVEAED AATYYCQQWTSNPPTFGGGTKLEIKDEL |
| SEQ ID NO: 169 | multivalent CD20-binding molecule component 123 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASAVAA GGGGSGGGQVQLQQPGAELVKPGASVKMSCKASGY TFTSYNMHWVKQTPGRGLEWIGAIYPGNGDTSYNQ KFKGKATLTADKSSSTAYMQLSSLTSEDSAVYYCA RSTYYGGDWYFNVWGAGTTVTVSAGGGGSTKGQI VLSQSPAILSASPGEKVTMTCRASSSVSYIHWFQQK PGSSPKPWIYATSNLASGVPVRFSGSGSGTSYSLTIS RVEAEDAATYYCQQWTSNPPTFGGGTKLEIK |
| SEQ ID NO: 170 | multivalent CD20-binding molecule component 124 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARE FPKPSTPPGSSGGAPQVQLVQSGAELVKPGASVKMS CKASGYTFTSYNMHWVKQTPGRGLEWIGAIYPGN GDTSYNQKFKGKATLTADKSSSTAYMQLSSLTSED SAVYYCARSTYYGGDWYFNVWGAGTTVTVSAGST SGSGKPGSGEGSDIVLSQSPAILSASPGEKVTMTCRA SSSVSYIHWFQQKPGSSPKPWIYATSNLASGVPAR FSGSGSGTSYSLTISRVEAEDAATYYCQQWTSNPPTF GAGTKLELK |
| SEQ ID NO: 171 | multivalent CD20-binding molecule component 125 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARE FPKPSTPPGSSGGAPQVQLVQSGAELVKPGASVKMS CKASGYTFTSYNMHWVKQTPGRGLEWIGAIYPGN GDTSYNQKFKGKATLTADKSSSTAYMQLSSLTSED SAVYYCARSTYYGGDWYFNVWGAGTTVTVSSGGG GSDIVLSQSPAILSASPGEKVTMTCRASSSVSYMHW YQQKPGSSPKPWIYATSNLASGVPVRFSGSGSGTSY SLTISRVEAEDAATYYCQQWTSNPPTFGGGTKLEIK |
| SEQ ID NO: 172 | multivalent CD20-binding molecule component 126 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASGGGGS FPKPSTPPGSSGGAPQVQLVQSGAELVKPGASVKMS GGQVQLVQSGAELVKPGASVKMSCKASGYTFTSY NMHWVKQTPGQGLEWIGAIYPGNGDTSYNQKFKG KATLTADKSSSTAYMQLSSLTSEDSAVYYCARAQL RPNYWYFDVWGAGTTVTVSSGSTSGSGKPGSGGEGS DIVLSQSPAILSASPGEKVTMTCRASSSVSYMHYQ QKPGSSPKPWIYATSNLASGVPVRFSGSGSGTSYSL TISRVEAEDAATYYCQQWTSNPPTFGGGTKLELK |

| ID Number | Text Description | Biological Sequence |
|---|---|---|
| SEQ ID NO: 173 | multivalent CD20-binding molecule component 127 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARE FPKPSTPPGSSGGAPQVQLVQSGAELVKPGASVKMS CKASGYTFTSYNMHWVKQTPGRGLEWIGAIYPGN GDTSYNQKFKGKATLTADKSSSTAYMQLSSLTSED SAVYYCARSTYYGGDWYFNVWGAGTTVTVSAGST SGSGKPGSGEGSTKGQIVLSQSPAILSASPGEKVTMT CRASSSVSYMHWYQQKPGSSPKPWIYATSNLASGVP VRFSGSGSGTSYSLTISRVEAEDAATYYCQQWTSNP PTFGGGTKLEIK |
| SEQ ID NO: 174 | multivalent CD20-binding molecule component 128 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASRVARE FPKPSTPPGSSGGAPQVQLQQPGAELVKPGASVKMS CKASGYTFTSYNMHWVKQTPGRGLEWIGAIYPGN GDTSYNQKFKGKATLTADKSSSTAYMQLSSLTSED SAVYYCARSTYYGGDWYFNVWGAGTTVTVSAGG GGSTKGQIVLSQSPAILSASPGEKVTMTCRASSSVSY IHWFQQKPGSSPKPWIYATSNLASGVPVRFSGSGSG TSYSLTISRVEAEDAATYYCQQWTSNPPTFGGGTKL EIK |
| SEQ ID NO: 175 | multivalent CD20-binding molecule component 129 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNSHHHASAVAA GGGGSGGQVQLQQPGAELVKPGASVKMSCKASGY TFTSYNMHWVKQTPGRGLEWIGAIYPGNGDTSYNQ KFKGKATLTADKSSSTAYMQLSSLTSEDSAVYYCA RSTYYGGDWYFNVWGAGTTVTVSAGGGGSGGGG SGGGGSGGGGAGGGGSTKGQIVLSQSPAILSASPGE KVTMTCRASSSVSYMHWYQQKPGSSPKPWIYATSNL ASGVPVRFSGSGSGTSYSLTISRVEAED |
| SEQ ID NO: 176 | multivalent CD20-binding molecule component 130 | QVQLQQPGAELVKPGASVKMSCKASGYTFTSYNM HWVKQTPGRGLEWIGAIYPGNGDTSYNQKFKGKAT LTADKSSSTAYMQLSSLTSEDSAVYYCARAQLRPNY WYFNVWGAGTTVTVSSGGGGSGGGGSGGGGSGGG GSGGGGSDIVLSQSPAILSASPGEKVTMTCRASSSVS YMHWYQQKPGSSPKPWIYATSNLASGVPARFSGSG SGTSYSLTISRVEAEDAATYYCQQWTSNPPTFGAGT KLELKEFPKPSTPPGSSGGAPKEFTLDFSTAKTYVDS LNVIRSAIGTPLQTISSGGTSLLMIDSGSGDNLFAVDV RGIDPEEGRFNNLRLIVERNNLYVTGFVNRTNNVFY RFADFSHVTFPGTTAVTLSGDSSYTTLQRVAGISRTG MQINRHSLTTSYLDLMSHSGTSLTQSVARAMLRFVTV LDDLSGRSYVMTAEDVDLLDDLSGRSYVMTAEDVDL TLNWGRLSSVLPDYHGQDSVRVGRISFGSINAILGSV ALILNSHHHASRVAR |
| SEQ ID NO: 177 | multivalent CD20-binding molecule component 131 | QVQLQQPGAELVKPGASVKMSCKASGYTFTSYNM HWVKQTPGRGLEWIGAIYPGNGDTSYNQKFKGKAT LTADKSSSTAYMQLSSLTSEDSAVYYCARAQLRPNY WYFNVWGAGTTVTVSSGSTSGSGKPGSGEGSDIVLS QSPAILSASPGEKVTMTCRASSSVSYMHWYQQKPGS SPKPWIYATSNLASGVPARFSGSGSGTSYSLTISRVE AEDAATYYCQQWTSNPPTFGAGTKLELKEFPKPSTP PGSSGGAPKEFTLDFSTAKTYVDSLNVIRSAIGTPLQ TISSGGTSLLMIDSGSGDNLFAVDVRGIDPEEGRFNN LRLIVERNNLYVTGFVNRTNNVFYRFADFSHVTFPG TTAVTLSGDSSYTTLQRVAGISRTGMQINRHSLTTSY LDLMSHSGTSLTQSVARAMLRFVTVTAEALRFRQIQ RGFRTTLDDLSGRSYVMTAEDVDLTLNWGRLSSVL |

Sequence Listing

| ID Number | Text Description | Biological Sequence |
|---|---|---|
| | | PDYHGQDSVRVGRISFGSINAILGSVALILNSHHHAS RVAR |
| SEQ ID NO: 178 | multivalent CD20-binding molecule component 132 | QVQLQQPGAELVKPGASVKMSCKASGYTFTSYNM HWVKQTPGRGLEWIGAIYPGNGDTSYNQKFKGKAT LTADKSSSTAYMQLSSLTSEDSAVYYCARAQLRPNY WYFNVWGAGTTVTVSSGGGGSDIVLSQSPAILSASP GEKVTMTCRASSSVSYMHWYQQKPGSSPKPWIYAT SNLASGVPARFSGSGSGTSYSLTISRVEAEDAATYYC QQWTSNPPTFGAGTKLELKEFPKPSTPPGSSGGAPKE FTLDFSTAKTYVDSLNVIRSAIGTPLQTISSGGTSLLM IDSGSGDNLFAVDVRGIDPEEGRFNNLRLIVERNNLY VTGFVNRTNNVFYRFADFSHVTFPGTTAVTLSGDSS YTTLQRVAGISRTGMQINRHSLTTSYLDLMSHSGTS LTQSVARAMLRFVTVLDDLSGRSYVMTAEDVDLLDDL SGASYVMTAEDVDLTLNWGRLSSVLPDYHGQDSVR VGRISFGSINAILGSVALILNSHHASRVAR |
| SEQ ID NO: 179 | multivalent CD20-binding molecule component 133 | QVQLQQPGAELVKPGASVKMSCKASGYTFTSYNM HWVKQTPGRGLEWIGAIYPGNGDTSYNQKFKGKAT LTADKSSSTAYMQLSSLTSEDSAVYYCARAQLRPNY WYFNVWGAGTTVTVSSGGGGSGGGGSGGGGSGGG GSGGGGSDIVLSQSPAILSASPGEKVTMTCRASSSVS YMHWYQQKPGSSPKPWIYATSNLASGVPARFSGSG SGTSYSLTISRVEAEDAATYYCQQWTSNPPTFGAGT KLELKGGGGSGGKEFTLDFSTAKTYVDSLNVIRSAI GTPLQTISSGGTSLLMIDSGSGDNLFAVDVRGIDPEE GRFNNLRLIVERNNLYVTGFVNRTNNVFYRFADFSH VTFPGTTAVTLSGDSSYTTLQRVAGISRTGMQINRHS LTTSYLDLMSHSATSLTQSVARAMLRFVTVTAEALR FRQIQRGFRTTLDDLSGASYVMTAEDVDLTLNWGR LSSVLPDYHGQDSVRVGRISFGSINAILGSVALILNSH HHASRVARKDEL |
| SEQ ID NO: 180 | multivalent CD20-binding molecule component 134 | QVQLQQPGAELVKPGASVKMSCKASGYTFTSYNM HWVKQTPGRGLEWIGAIYPGNGDTSYNQKFKGKAT LTADKSSSTAYMQLSSLTSEDSAVYYCARAQLRPNY WYFDNVWGAGTTVTVSSGSTSGSGKPGSGEGSDIVELS QSPAILSASPGEKVTMTCRASSSVSYMHWYQQKPGS SPKPWIYATSNLASGVPARFSGSGSGTSYSLTISRVE AEDAATYYCQQWTSNPPTFGAGTKLELKGGGGSGG KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVAR |
| SEQ ID NO: 181 | multivalent CD20-binding molecule component 135 | QVQLQQPGAELVKPGASVKMSCKASGYTFTSYNM HWVKQTPGRGLEWIGAIYPGNGDTSYNQKFKGKAT LTADKSSSTAYMQLSSLTSEDSAVYYCARAQLRPNY WYFDNVWGAGTTVTVSSGGGGSDIVLSQSPAILSASP GEKVTMTCRASSSVSYMHWYQQKPGSSPKPWIYAT SNLASGVPARFSGSGSGTSYSLTISRVEAEDAATYYC QQWTSNPPTFGAGTKLELKEFPKPSTPPGSSGGAPGI LGFVFTLKEFTLDFSTAKTYVDSLNVIRSAIGTPLQTI SSGGTSLLMIDSGSGDNLFAVDVRGIDPEEGRFNNL RLIVERNNLYVTGFVNRTNNVFYRFADFSHVTFPGT TAVTLSGDSSYTTLQRVAGISRTGMQINRHSLTTSYL DLMSHSGTSLTQSVARAMLRFVTVTAEALRFRQIQR GFRTTLDDLSGASYVMTAEDVDLTLNWGRLSSVLP DYHGQDSVRVGRISFGSINAILGSVALILNSHHASA VAA |
| SEQ ID NO: 182 | multivalent CD20-binding molecule component 136 | QVQLQQPGAELVKPGASVKMSCKASGYTFTSYNVH WVKQTPGRGLEWIGAIYPGNGDTSYNQKFKGKATL TADKSSSTAYMQLSSLTSEDSAVYYCARSNYYGSSY VWFFDVWGAGTTVTVSSGGGGSGGGGSGGGGSGG GGSGGGGSQIVLSQSPTILSASPGEKVTMTCRASSSV SYMHWYQQKPGSSPKPWIYATSNLASGVPARFSGS GSGTSYSLTISRVEAEDAATYYCQQWTSNPPTFGAG TKLELKEFPKPSTPPGSSGGAPKEFTLDFSTAKTYVD SLNVIRSAIGTPLQTISSGGTSLLMIDSGSGDNLFAVD VRGIDPEEGRFNNLRLIVERNNLYVTGFVNRTNNVF |

Sequence Listing

| ID Number | Text Description | Biological Sequence |
|---|---|---|
| | | YRFADFSHVTFPGTTAVTLSGDSSYTTLQRVAGISRT<br>GMQINRHSLTTSYLDLMSHSGTSLTQSVARAMLRFV<br>TVTAEALRFRQIQRGFRTTLDDLSGASYVMTAEDVD<br>LTLNWGRLSSVLPDYHGQDSVRVGRISFGSINAILGS<br>VALILNSHHHASRVAR |
| SEQ ID NO: 183 | multivalent CD20-<br>binding molecule<br>component 137 | MQVQLQQPGAELVKPGASVKMSCKASGYTFTSYNV<br>HWVKQTPGRGLEWIGAIYPGNGDTSYNQKFKGKAT<br>LTADKSSSTAYMQLSSLTSEDSAVYYCARSNYYGSS<br>YVWFFDVWGAGTTVTVSSGSTSGSGKPGSGEGSQI<br>VLSQSPTILSASPGEKVTMTCRASSSVSYMHWYQQK<br>PGSSPKPWIYATSNLASGVPARFSGSGSGTSYSLTISR<br>VEAEDAATYYCQQWTSNPPTFGAGTKLELKEFPKPS<br>TPPGSSGGAPKEFTLDFSTAKTYVDSLNVIRSAIGTPL<br>QTISSGGTSLLMIDSGSGDNLFAVDVRGIDPEEGRFN<br>NLRLIVERNNLYVTGFVNRTNNVFYRFADFSHVTFP<br>GTTAVTLSGDSSYTTLQRVAGISRTGMQINRHSLTTS<br>YLDLMSHSGTSLTQSVARAMLRFVTVTAEALRFRQI<br>QRGFRTTLDDLSGASYVMTAEDVDLTLNWGRLSSV<br>LPDYHGQDSVRVGRISFGSINAILGSVALILNSHHHA<br>SRVAR |
| SEQ ID NO: 184 | multivalent CD20-<br>binding molecule<br>component 138 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGSTSGSGKPGSGEGSQIVL<br>SQSPTILSASPGEKVTMTCRASSSVSYMHWYQQKPG<br>SSPKPWIYATSNLASGVPARFSGSGSGTSYSLTISRVE<br>AEDAATYYCQQWTSNPPTFGAGTKLELKEFPKPSTP<br>PGSSGGAPKEFTLDFSTAKTYVDSLNVIRSAIGTPLQ<br>TISSGGTSLLMIDSGSGDNLFAVDVRGIDPEEGRFNN<br>LRLIVERNNLYVTGFVNRTNNVFYRFADFSHVTFPG<br>TTAVTLSGDSSYTTLQRVAGISRTGMQINRHSLTTSY<br>LDLMSHSGTSLTQSVARAMLRFVTVTAEALRFRQIQ<br>RGFRTTLDDLSGASYVMTAEDVDLTLNWGRLSSVL<br>PDYHGQDSVRVGRISFGSINAILGSVALILNSHHHAS<br>RVAR |
| SEQ ID NO: 185 | multivalent CD20-<br>binding molecule<br>component 139 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGGGGSQIVLSQSPTILSAS<br>PGEKVTMTCRASSSVSYMHWYQQKPGSSPKPWIYA<br>TSNLASGVPARFSGSGSGTSYSLTISRVEAEDAATYY<br>CQQWTSNPPTFGAGTKLELKEFPKPSTPPGSSGGAPK<br>EFTLDFSTAKTYVDSLNVIRSAIGTPLQTISSGGTSLL<br>MIDSGSGDNLFAVDVRGIDPEEGRFNNLRLIVERNN<br>LYVTGFVNRTNNVFYRFADFSHVTFPGTTAVTLSGD<br>SSYTTLQRVAGISRTGMQINRHSLTTSYLDLMSHSG<br>TSLTQSVARAMLRFVTVTAEALRFRQIQRGFRTTLD<br>DLSGASYVMTAEDVDLTLNWGRLSSVLPDYHGQDS<br>VRVGRISFGSINAILGSVALILNSHHHASRVAR |
| SEQ ID NO: 186 | multivalent CD20-<br>binding molecule<br>component 140 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGGGGSGGGGSGGGGSGG<br>GGSGGGGSQIVLSQSPTILSASPGEKVTMTCRASSSV<br>SYMHWYQQKPGSSPKPWIYATSNLASGVPARFSGS<br>GSGTSYSLTISRVEAEDAATYYCQQWTSNPPTFGAG<br>TKLELKGGGGSGGKEFTLDFSTAKTYVDSLNVIRSAI<br>GTPLQTISSGGTSLLMIDSGSGDNLFAVDVRGIDPEE<br>GRFNNLRLIVERNNLYVTGFVNRTNNVFYRFADFSH<br>VTFPGTTAVTLSGDSSYTTLQRVAGISRTGMQINRHS<br>LTTSYLDLMSHSGTSLTQSVARAMLRFVTVTAEALR<br>FRQIQRGFRTTLDDLSGASYVMTAEDVDLTLNWGR<br>LSSVLPDYHGQDSVRVGRISFGSINAILGSVALILNSH<br>HHASRVAR |
| SEQ ID NO: 187 | multivalent CD20-<br>binding molecule<br>component 141 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGSTSGSGKPGSGEGSQIVL<br>SQSPTILSASPGEKVTMTCRASSSVSYMHWYQQKPG<br>SSPKPWIYATSNLASGVPARFSGSGSGTSYSLTISRVE |

| ID Number | Text Description | Biological Sequence |
|---|---|---|
| | | AEDAATYYCQQWTSNPPTFGAGTKLELKGGGGSGG<br>KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHHASRVAR |
| SEQ ID NO: 188 | multivalent CD20-<br>binding molecule<br>component 142 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGGGGSGGGGSGGGGSGG<br>GGSGGGGSQIVLSQSPTILSASPGEKVTMTCRASSSV<br>SYMHWYQQKPGSSPKPWIYATSNLASGVPARFSGS<br>GSGTSYSLTISRVEAEDAATYYCQQWTSNPPTFGAG<br>TKLELKEFPKPSTPPGSSGGAPGILGFVFTLKEFTLDF<br>STAKTYVDSLNVIRSAIGTPLQTISSGGTSLLMIDSGS<br>GDNLFAVDVRGIDPEEGRFNNLRLIVERNNLYVTGF<br>VNRTNNVFYRFADFSHVTFPGTTAVTLSGDSSYTTL<br>QRVAGISRTGMQINRHSLTTSYLDLMSHSGTSLTQS<br>VARAMLRFVTVTAEALRFRQIQRGFRTTLDDLSGRS<br>YVMTAEDVDLTLNWGRLSSVLPDYHGQDSVRVGRI<br>SFGSINAILGSVALILNSHHHASRVAR |
| SEQ ID NO: 189 | multivalent CD20-<br>binding molecule<br>component 143 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGSTSGSGKPGSGEGSQIVL<br>SQSPTILSASPGEKVTMTCRASSSVSYMHWYQQKPG<br>SSPKPWIYATSNLASGVPARFSGSGSGTSYSLTISRVE<br>AEDAATYYCQQWTSNPPTFGAGTKLELKEFPKPSTP<br>PGSSGGAPGILGFVFTLKEFTLDFSTAKTYVDSLNVI<br>RSAIGTPLQTISSGGTSLLMIDSGSGDNLFAVDVRGI<br>GDPEERFNNLRLIVERNNLYVTGFVNRTNNVFYRFA<br>DFSHVTFPGTTAVTLSGDSSYTTLQRVAGISRTGMQI<br>NRHSLTTSYLDLMSHSGTSLTQSVARAMLRFVTVTA<br>EALRFRQIQRGFRTTLDDLSGASYVMTAEDVDLTLN<br>WGRLSSVLPDYHGQDSVRVGRISFGSINAILGSVALI<br>LNSHHHASRVAR |
| SEQ ID NO: 190 | multivalent CD20-<br>binding molecule<br>component 144 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGGGGSQIVLSQSPTILSAS<br>PGEKVTMTCRASSSVSYMHWYQQKPGSSPKPWIYA<br>TSNLASGVPARFSGSGSGTSYSLTISRVEAEDAATYY<br>CQQWTSNPPTFGAGTKLELKEFPLPSTPPGSSGGAPG<br>ILGFVFTLKEFTLDFSTAKTYVDSLNVIRSAIGTPLQT<br>ISSGGTSLLMIDSGSGDNLFAVDVRGIDPEEGRFNNL<br>RLIVERNNLYVTGFVNRTNNVFYRFADFSHVTFPGT<br>TAVTLSGDSSYTTLQRVAGISRTGMQINRHSLTTSYL<br>DLMSHSGTSLTQSVARAMLRFVTVTAEALRFRQIQR<br>GFRTTLDDLSGASYVMTAEDVDLTLNWGRLSSVLP<br>DYHGQDSVRVGRISFGSINAILGSVALILNSHHHASR<br>VAR |
| SEQ ID NO: 191 | multivalent CD20-<br>binding molecule<br>component 145 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGGGGSQIVLSQSPTILSAS<br>PGEKVTMTCRASSSVSYMHWYQQKPGSSPKPWIYA<br>TSNLASGVPARFSGSGSGTSYSLTISRVEAEDAATYY<br>CQQWTSNPPTFGAGTKLELKGGGGSGGKEFTLDFST<br>AKTYVDSLNVIRSAIGTPLQTISSGGTSLLMIDSGTG<br>DNLFAVDVRGIDPEEGRFNNLRLIVERNNLYVTGFV<br>NRTNNVFYRFADFSHVTFPGTTAVTLSGDSSYTTLQ<br>RVAGISRTGMQINRHSLTTSYLDLMSHSGTSLTQSV<br>ARAMLRFVTVTAEALRFRQIQRGFRTTLDDLSGASY<br>VMTAEDVDLTLNWGRLSSVLPDYHGQDSVRVGRIS<br>FGSINAILGSVALILNSHHHASRVAR |
| SEQ ID NO: 192 | multivalent CD20-<br>binding molecule<br>component 146 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY |

| Sequence Listing | | |
|---|---|---|
| ID Number | Text Description | Biological Sequence |
| | | VWFFDVWGAGTTVTVSSGGGGSGGGGSGGGGSGG<br>GGSSGGGGSQIVLSQSPTILSASPGEKVTMTCRASSSV<br>SYMDWYQQKPGSSPKPWIYATSNLASGVPARFSGS<br>GSGTSYSLTISRVEAEDAATYYCQQWTSNPPTFGAG<br>TKLELKEFPLPSTPPGSSGGAPGKEFTLDFSTAKTYVD<br>SLNVIRSAIGTPLQTISSGGTSLLMIDSGSGDNLFAVD<br>VRGIDPEEGRFNNLRLIVERNNLYVTGFVNRTNNVF<br>YRFADFSHVTFPGTTAVTLSGDSSYTTLQRVAGISRT<br>GMQINRHSLTTSYLDLMSHSGTSLTQSVARAMLRFV<br>TVTAEALRFRQIQRGFRTTLDDLSGASYVMTAEDVD<br>LTLNWGRLSSVLPDYHGQDSVRVGRISFGSINAILGS<br>VALILNSHHHAS |
| SEQ ID NO: 193 | multivalent CD20-<br>binding molecule<br>component 147 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGSTSGSGKPGSGEGSQIVL<br>SQSPTILSASPGEKVTMTCRASSSVSYMHWYQQKPG<br>SSPKPWIYATSNLASGVPARFSGSGSGTSYSLTISRVE<br>AEDAATYYCQQWTSNPPTFGAGTKLELKEFPLPSTP<br>PGSSGGKEFTLDFSTAKTYVDSLNVIRSAIGTPLQ<br>TISSGGTSLLMIDSGSGDNLFAVDVRGIDPEEGRFN<br>NLRLIVERNNLYVTGFVNRTNNVFYRFADFSHVTFP<br>GTTAVTLSGDSSYTTLQRVAGISRTGMQINRHSLTTS<br>YLDLMSHSGTSLTQSVARAMLRFVTVTAEALRFRQI<br>QRGFRTTLDDLSGASYVMTAEDVDLTLNWGRLSSV<br>LPDYHGQDSVRVGRISFGSINAILGSVALILNSHHHA<br>SRVAR |
| SEQ ID NO: 194 | multivalent CD20-<br>binding molecule<br>component 148 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGGGGSGGGGSGGGGSGG<br>GGSGGGGSQIVLSQSPTILSASPGEKVTMTCRASSSV<br>SYMHWYQQKPGSSPKPWIYATSNLASGVPARFSGS<br>GSGTSYSLTISRVEAEDAATYYCQQWTSNPPTFGAG<br>TKLELKEFPLPSTPPGSSGGAPGILGFVFTLKEFTLDF<br>STAKTYVDSLNVIRSAIGTPLQTISSGGTSLLMIDSGS<br>GDNLFAVDVRGIDPEEGRFNNLRLIVERNNLYVTGF<br>VNRTNNVFYRFADFSHVTFPGTTAVTLSGDSSYTTL<br>QRVAGISRTGMQINRHSLTTSYLDLMSHSGTSLTQS<br>VARAMLRFVTVTAEALRFRQIQRGFRTTLDDLSGAS<br>YVMTAEDVDLTLNWGRLSSVLPDYHGQDSVRVGRI<br>SFGSINAILGSVALILNSHHHAS |
| SEQ ID NO: 195 | multivalent CD20-<br>binding molecule<br>component 149 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGGGGSGGGGSGGGGSGG<br>GGSGGGGSQIVLSQSPTILSASPGEKVTMTCRASSSV<br>SYMHWYQQKPGSSPKPWIYATSNLASGVPARFSGS<br>GSGTSYSLTISRVEAEDAATYYCQQWTSNPPTFGAG<br>TKLELKEFPLPSTPPGSSGGAPKEFTLDFSTAKTYVD<br>SLNVIRSAIGTPLQTISSGGTSLLMIDSGSGDNLFAVD<br>VRGIDPEEGRFNNLRLIVERNNLYVTGFVNRTNNVF<br>YRFADFSHVTFPGTTAVTLSGDSSYTTLQRVAGISRT<br>GMQINRHSLTTSYLDLMSHSGTSLTQSVARAMLRFV<br>TVTAEALRFRQIQRGFRTTLDDLSGASYVMTAEDVD<br>LTLNWGRLSSVLPDYHGQDSVRVGRISFGSINAILGS<br>VALILNSHHHASRVARKDEL |
| SEQ ID NO: 196 | multivalent CD20-<br>binding molecule<br>component 150 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGSTSGSGKPGSGEGSQIVL<br>SQSPTILSASPGEKVTMTCRASSSVSYMHWYQQKPG<br>SSPKPWIYATSNLASGVPARFSGSGSGTSYSLTISRVE<br>AEDAATYYCQQWTSNPPTFGAGTKLELKEFPLPSTP<br>PGSSGGAPKEFTLDFSTAKTYVDSLNVIRSAIGTPLQ<br>TISSGGTSLLMIDSGSGDNLFAVDVRGIDPEEGRFNN<br>LRLIVERNNLYVTGFVNRTNNVFYRFADFSHVTFPG<br>TTAVTLSGDSSYTTLQRVAGISRTGMQINRHSLTTSY<br>LDLMSHSGTSLTQSVARAMLRFVTVTAEALRFRQIQ<br>RGFRTTLDDLSGASYVMTAEDVDLTLNWGRLSSVL |

| Sequence Listing | | |
|---|---|---|
| ID Number | Text Description | Biological Sequence |
| | | PDYHGQDSVRVGRISFGSINAILGSVALILNSHHHAS<br>RVARKDEL |
| SEQ ID NO: 197 | multivalent CD20-<br>binding molecule<br>component 151 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGGGGSQIVLSQSPTILSAS<br>PGEKVTMTCRASSSVSYMHWYQQKPGSSPKPWIYA<br>TSNLASGVPARFSGSGSGTSYSLTISRVEAEDAATYY<br>CQQWTSNPPTFGAGTKLELKEFPLPSTPPGSSGGAPK<br>EFTLDFSTAKTYVDSLNVIRSAIGTPLQTISSGGTSLL<br>MIDSGSGDNLFAVDVRGIDPEEGRFNNLRLIVERNN<br>LYVTGFVNRTNNVFYRFADFSHVTFPGTTAVTLSGD<br>SSYTTLQRVAGISRTGMQINRHSLTTSYLDLMSHSG<br>TSLTQSVARAMLRFVTVTAEALRFRQIQRGFRTTLD<br>DLSGASYVMTAEDVDLTLNWGRLSSVLPDYHGQDS<br>VRVGRISFGSINAILGSVALILNSHHASRVARKDEL |
| SEQ ID NO: 198 | multivalent CD20-<br>binding molecule<br>component 152 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGGGGSGGGGSGGGGSGG<br>GGSGGGGSQIVLSQSPTILSASPGEKVTMTCRASSSV<br>SYMHWYQQKPGSSPKPWIYATSNLASGVPARFSGS<br>GSGTSYSLTISRVEAEDAATYYCQQWTSNPPTFGAG<br>TKLELKGGGGSGGKEFTLDFSTAKTYVDSLNVIRSAI<br>GTPLQTISSGGTSLLMIDSGSGDNLFAVDVRGIDPEE<br>GRFNNLRLIVERNNLYVTGFVNRTNNVFYRFADFSH<br>VTFPGTTAVTLSGDSSYTTLQRVAGISRTGMQINRHS<br>LTTSYLDLMSHSGTSLTQSVARAMLRFVTVTAEALR<br>FRQIQRGFRTTLDDLSGASYVMTAEDVDLTLNWGR<br>LSSVLPDYHGQDSVRVGRISFGSINAILGSVALILNSH<br>HHASRVARKDEL |
| SEQ ID NO: 199 | multivalent CD20-<br>binding molecule<br>component 153 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGSTSGSGKPGEGSQIVL<br>SQSPTILSASPGEKVTMTCRASSSVSYMHWYQQKPG<br>SSPKPWIYATSNLASGVPARFSGSGSGTSYSLTISRVE<br>AEDAATYYCQQWTSNPPTFGAGTKLELKGGGGSGG<br>KEFTLDFSTAKTYVDSLNVIRSAIGTPLQTISSGGTS<br>LLMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHHASRVARKD<br>EL |
| SEQ ID NO: 200 | multivalent CD20-<br>binding molecule<br>component 154 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGGGGSGGGGSGGGGSGG<br>GGSGGGGSQIVLSQSPTILSASPGEKVTMTCRASSSV<br>SYMHWYQQKPGSSPKPWIYATSNLASGVPARFSGS<br>GSGTSYSLTISRVEAEDAATYYCQQWTSNPPTFGAG<br>TKLELKEFPKPSTPPGSSGGAPGILGFVFTLKEFTLDF<br>STAKTYVDSLNVIRSAIGTPLQTISSGGTSLLMIDSGS<br>GDNLFAVDVRGIDPEEGRFNNLRLIVERNNLYVTGF<br>VNRTNNVFYRFADFSHVTFPGTTAVTLSGDSSYTTL<br>QRVAGISRTGMQINRHSLTTSYLDLMSHSGTSLTQS<br>VARAMLRFVTVTAEALRFRQIQRGFRTTLDDLSGAS<br>YVMTAEDVDLTLNWGRLSSVLPDYHGQDSVRVGRI<br>SFGSINAILGSVALILNSHHASRVARKDEL |
| SEQ ID NO: 201 | multivalent CD20-<br>binding molecule<br>component 155 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSNYYGSSY<br>VWFFDVWGAGTTVTVSSGSTSGSGKPGEGSQIVL<br>SQSPTILSASPGEKVTMTCRASSSVSYMHWYQQKPG<br>SSPKPWIYATSNLASGVPARFSGSGSGTSYSLTISRVE<br>AEDAATYYCQQWTSNPPTFGAGTKLELKEFPKPSTP<br>PGSSGGAPGILGFVFTLKEFTLDFSTAKTYVDSLNVI<br>RSAIGTPLQTISSGGTSLLMIDSGSGDNLFAVDVRGI |

-continued

| ID Number | Text Description | Biological Sequence |
|---|---|---|
| | | DPEEGRFNNLRLIVERNNLYVTGFVNRTNNVFYRFA DFSHVTFPGTTAVTLSGDSSYTTLQRVAGISRTGMQI NRHSLTTSYLDLMSHSGTSLTQSVARAMLRFVTVTA EALRFRQIQRGFRTTLDDLSGASYVMTAEDVDLTLN WGRLSSVLPDYHGQDSVRVGRISFGSINAILGSVALI LNSHHHASRVARKDEL |
| SEQ ID NO: 202 | multivalent CD20-binding molecule component 156 | QVQLQQPGAELVKPGASVKMSCKASGYTFTSYNVH WVKQTPGRGLEWIGAIYPGNGDTSYNQKFKGKATL TADKSSSTAYMQLSSLTSEDSAVYYCARSNYYGSSY VWFFDVWGAGTTVTVSSGGGGSQIVLSQSPTILSAS PGEKVTMTCRASSSVSYMHWYQQKPGSSPKPWIYA TSNLASGVPARFSGSGSGTSYSLTISRVEAEDAATYY CQQWTSNPPTFGAGTKLELKEFPLPSTPPGSSGGAP ILGFVFTLKEFTLDFSTAKTYVDSLNVIRSAIGTPLQT ISSGGTSLLMIDSGSGDNLFAVDVRGIDPEEGRFNNL RLIVERNNLYVTGFVNRTNNVFYRFADFSHVTFPGT TAVTLSGDSSYTTLQRVAGISRTGMQINRHSLTTSYL DLMSHSGTSLTQSVARAMLRFVTVTAEALRFRQIQR GFRTTLDDLSGASYVMTAEDVDLTLNWGRLSSVLP DYHGQDSVRVGRISFGSINAILGSVALILNSHHHASR VARKDEL |
| SEQ ID NO: 203 | multivalent CD20-binding molecule component 157 | QVQLQQPGAELVKPGASVKMSCKASGYTFTSYNVH WVKQTPGRGLEWIGAIYPGNGDTSYNQKFKGKATL TADKSSSTAYMQLSSLTSEDSAVYYCARSNYYGSSY VWFFDVWGAGTTVTVSSGGGGSQIVLSQSPTILSAS PGEKVTMTCRASSSVSYMHWYQQKPGSSPKPWIYA TSNLASGVPARFSGSGSGTSYSLTISRVEAEDAATYY CQQWTSNPPTFGAGTKLELKGGGGSGGKEFTLDFST AKTYVDSLNVIRSAIGTPLQTISSGGTSLLMIDSGSG DNLFAVDVRGIDPEEGRFNNLRLIVERNNLYVTGFV NRTNNVFYRFADFSHVTFPGTTAVTLSGDSSYTTLQ RVAGISRTGMQINRHSLTTSYLDLMSHSGTSLTQSV ARAMLRFVTVTAEALRFRQIQRGFRTTLDDLSGASY VMTAEDVDLTLNWGRLSSVLPDYHGQDSVRVGRIS FGSINAILGSVALILNSHHHASRVARKDEL |
| SEQ ID NO: 204 | multivalent CD20-binding molecule component 158 | QVQLQQPGAELVKPGASVKMSCKASGYTFTSYNVH WVKQTPGRGLEWIGAIYPGNGDTSYNQKFKGKATL TADKSSSTAYMQLSSLTSEDSAVYYCARSNYYGSSY VWFFDVWGAGTTVTVSSGGGGSGGGGSGGGGSGG GGSGGGGSQIVLSQSPTILSASPGEKVTMTCRASSSV SYMHWYQQKPGSSPKPWIYATSNLASGVPARFSGS GSGTSYSLTISRVEAEDAATYYCQQWTSNPPTFGAG TKLELKEFPLPSTPPGSSGGAPKEFTLDFSTAKTYVD SLNVIRSAIGTPLQTISSGGTSLLMIDSGSGDNLFAVD VRGIDPEEGRFNNLRLIVERNNLYVTGFVNRTNNVF YRFADFSHVTFPGTTAVTLSGDSSYTTLQRVAGISRT GMQINRHSLTTSYLDLMSHSGTSLTQSVARAMLRFV TVTAEALRFRQIQRGFRTTLDDLSGASYVMTAEDVD LTLNWGRLSSVLPDYHGQDSVRVGRISFGSINAILGS VALILNSHHHASKDEL |
| SEQ ID NO: 205 | multivalent CD20-binding molecule component 159 | QVQLQQPGAELVKPGASVKMSCKASGYTFTSYNVH WVKQTPGRGLEWIGAIYPGNGDTSYNQKFKGKATL TADKSSSTAYMQLSSLTSEDSAVYYCARSNYYGSSY VWFFDVWGAGTTVTVSSGSTSGSGKPGEGSQIVL SQSPTILSASPGEKVTMTCRASSSVSYMHWYQQKPG SSPKPWIYATSNLASGVPARFSGSGSGTSYSLTISRVE AEDAATYYCQQWTSNPPTFGAGTKLELKEFPKPSTP PGSSGGAPKEFTLDFSTAKTYVDSLNVIRSAIGTPLQ TISSGGTSLLMIDSGSGDNLFAVDVRGIDPEEGRFN NLRLIVERNNLYVTGFVNRTNNVFYRFADFSHVTFP GTTAVTLSGDSSYTTLQRVAGISRTGMQINRHSLTTS YLDLMSHSGTSLTQSVARAMLRFVTVTAEALRFRQI QRGFRTTLDDLSGASYVMTAEDVDLTLNWGRLSSV LPDYHGQDSVRVGRISFGSINAILGSVALILNSHHHA SRVARKDEL |
| SEQ ID NO: 206 | multivalent CD20-binding molecule component 160 | QVQLQQPGAELVKPGASVKMSCKASGYTFTSYNVH WVKQTPGRGLEWIGAIYPGNGDTSYNQKFKGKATL TADKSSSTAYMQLSSLTSEDSAVYYCARSNYYGSSY VWFFDVWGAGTTVTVSSGGGGSGGGGSGGGGSGG GGSGGGGSQIVLSQSPTILSASPGEKVTMTCRASSV |

| Sequence Listing | | |
|---|---|---|
| ID Number | Text Description | Biological Sequence |
| | | SYMHWYQQKPGSSPKPWIYATSNLASGVPARFSGS<br>GSGTSYSLTISRVEAEDAATYYCQQWTSNPPTFGAG<br>TKLELKEFPKPSTPPGSSGGAPGILGFVFTLKEFTLDF<br>STAKTYVDSLNVIRSAIGTPLQTISSGGTSLLMIDSGS<br>GDNLFAVDVRGIDPEEGRFNNLRLIVERNNLYVTGF<br>VNRTNNVFYRFADFSHVTFPGTTAVTLSGDSSYTTL<br>QRVAGISRTGMQINRHSLTTSYLDLMSHSGTSLTQS<br>VARAMLRFVTVTAEALRFRQIQRGFRTTLDDLSGAS<br>YVMTAEDVDLTLNWGRLSSVLPDYHGQDSVRVGRI<br>SFGSINAILGSVALILNSHHASRVARKDEL |
| SEQ ID NO: 207 | multivalent CD20-<br>binding molecule<br>component 161 | QVQLQQPGAELVKPGASVKMSCKASGYTFTSYNM<br>HWVKQTPGRGLEWIGAIYPGNGDTSYNQKFKGKAT<br>LTADKSSSTAYMQLSSLTSEDSAVYYCARSTYYGG<br>DWYFNVWGAGTTVTVSAGSTSGSGKPGSGEGSTKG<br>QIVLSQSPAILSASPGEKVTMTCRASSSVSYIHWFQQ<br>KPGSSPKPWIYATSNLASGVPARFSGSGSGTSYSLTIS<br>RVEAEDAATYYCQQWTSNPPTFGGGTKLELKEFPKP<br>STPPGSSGGAPKEFTLDFSTAKTYVDSLNVIRSAIGTP<br>LQTISSGGTSLLMIDSGSGDNLFAVDVRGIDPEEGRF<br>NNLRLIVERNNLYVTGFVNRTNNVFYRFADFSHVTF<br>PGTTAVTLSGDSSYTTLQRVAGISRTGMQINRHSLTT<br>SYLDLMSHSGTSLTQSVARAMLRFVTVTAEALRFR<br>QIQRGFRTTLDDLSGRSYVMTAEDVDLTLNWGRLS<br>SVLPDYHGQDSVRVGRISFGSINAILGSVALILNSHH<br>HASRVAR |
| SEQ ID NO: 208 | multivalent CD20-<br>binding molecule<br>component 162 | QVQLQQPGAELVKPGASVKMSCKASGYTFTSYNVH<br>WVKQTPGRGLEWIGAIYPGNGDTSYNQKFKGKATL<br>TADKSSSTAYMQLSSLTSEDSAVYYCARSTYYGG<br>DWYFNVWGAGTTVTVSAGGGGSTKGQIVLSQSPAI<br>LSASPGEKVTMTCRASSSVSYMHWYQQKPGSSPKPW<br>IYATSNLASGVPARFSGSGSGTSYSLTISRVEAEDAA<br>TYYCQQWTSNPPTFGAGTKLELKGGGGSGGKEFTLD<br>FSTAKTYVDSLNVIRSAIGTPLQTISSGGTSLLMIDSG<br>SGDNLFAVDVRGIDPEEGRFNNLRLIVERNNLYVTG<br>FVNRTNNVFYRFADFSHVTFPGTTAVTLSGDSSYTT<br>LQRVAGISRTGMQINRHSLTTSYLDLMSHSGTSLTQ<br>SVARAMLRFVTVTAEALRFRQIQRGFRTTLDDLSGR<br>SYVMTAEDVDLTLNWGRLSSVLPDYHGQDSVRVG<br>RISFGSINAILGSVALILNSHHHASRVAR |
| SEQ ID NO: 209 | multivalent CD20-<br>binding molecule<br>component 163 | QVQLQQPGAELVKPGASVKMSCKASGYTFTSYNV<br>HWVKQTPGRGLEWIGAIYPGNGDTSYNQKFKGKAT<br>LTADKSSSTAYMQLSSLTSEDSAVYYCARSTYYGG<br>DWYFNVWGAGTTVTVSAGGGGSGGGGSGGGGSG<br>GGGSGGGGSTKGQIVLSQSPAILSASPGEKVTMTCR<br>ASSSVSYMHWYQQKPGSSPKPWIYATSNLASGVPARF<br>SGSGSGTSYSLTISRVEAEDAATYYCQQWTSNPPTF<br>GGGTKLEIKEFPKPSTPPGSSGGAPKEFTLDFSTAKT<br>YVDSLNVIRSAIGTPLQTISSGGTSLLMIDSGSGDNLF<br>AVDVRGIDPEEGRFNNLRLIVERNNLYVTGFVNRTN<br>NVFYRFADFSHVTFPGTTAVTLSGDSSYTTLQRVAG<br>ISRTGMQINRHSLTTSYLDLMSHSGTSLTQSVARAM<br>LRFVTVTAEALRFRQIQRGFRTTLDDLSGRSYVMTA<br>EDVDLTLNWGRLSSVLPDYHGQDSVRVGRISFGSIN<br>AILGSVALILNSHHHASRVARKDEL |
| SEQ ID NO: 210 | multivalent CD20-<br>binding molecule<br>component 164 | QVQLQQPGAELVKPGASVKMSCKASGYTFTSYNM<br>HWVKQTPGRGLEWIGAIYPGNGDTSYNQKFKGKAT<br>LTADKSSSTAYMQLSSLTSEDSAVYYCARSTYYGG<br>DWYFNVWGAGTTVTVSAGGGGSTKGQIVLSQSPAI<br>LSASPGEKVTMTCRASSSVSYMHWYQQKPGSSPKPW<br>IYATSNLASGVPARFSGSGSGTSYSLTISRVEAEDAA<br>TYYCQQWTSNPPTFGGGTKLEIKEFPKPSTPPGSSGG<br>APKEFTLDFSTAKTYVDSLNVIRSAIGTPLQTISSGGT<br>SLLMIDSGSGDNLFAVDVRGIDPEEGRFNNLRLIVER<br>NNLYVTGFVNRTNNVFYRFADFSHVTFPGTTAVTLS<br>ADSSYTTLQRVAGISRTGMQINRHSLTTSYLDLMSH<br>SATSLTQSVARAMLRFVTVTAEALRFRQIQRGFRTT<br>LDDLSGRSYVMTAEDVDLTLNWGRLSSVLPDYHGQ<br>DSVRVGRISFGSINAILGSVALILNSHHHASRVAR |

| | | Sequence Listing |
|---|---|---|
| ID Number | Text Description | Biological Sequence |
| SEQ ID NO: 211 | multivalent CD20-binding molecule component 165 | QVQLQQPGAELVKPGASVKMSCKASGYTFTSYNM HWVKQTPGRGLEWIGAIYPGNGDTSYNQKFKGKAT LTADKSSSTAYMQLSSLTSEDSAVYYCARSTYYGG DWYFNVWGAGTTVTVSAGSTSGSGKPGSGEGSTKG QIVLSQSPAILSASPGEKVTMTCRASSSVSYIHWFQQ KPGSSPKPWIYATSNLASGVPARFSGSGSGTSYSLTIS RVEAEDAATYYCQQWTSNPPTFGGGTKLEIKEFPKP STPPGSSGGAPKEFTLDFSTAKTYVDSLNVIRSAIGTP LQTISSGGTSLLMIDSGSGDNLFAVDVRGIDPEEGRF NNLRLIVERNNLYVTGFVNRTNNVFYRFADFSHVTF PGTTAVTLSGDSSYTTLQRVAGISRTGMQINRHSLTT SYLDLMSHSGTSLTQSVARAMLRFVTVTAEALRFR QIQRGFRTTLDDLSGRSYVMTAEDVDLTLNWGRLS SVLPDYHGQDSVRVGRISFGSINAILGSVALILNSHH HASRVAR |
| SEQ ID NO: 212 | multivalent CD20-binding molecule component 166 | QVQLQQPGAELVKPGASVKMSCKASGYTFTSYNM HWVKQTPGRGLEWIGAIYPGNGDTSYNQKFKGKAT LTADKSSSTAYMQLSSLTSEDSAVYYCARSTYYGG DWYFNVWGAGTTVTVSAGSTSGSGKPGSGEGSTKG QIVLSQSPAILSASPGEKVTMTCRASSSVSYIHWFQQ KPGSSPKPWIYATSNLASGVPVRFSGSGSGTSYSLTIS RVEAEDAATYYCQQWTSNPPTFGGGTKLEIKEFPKP STPPGSSGGAPGILGFVFTLKEFTLDFSTAKTYVDSL NVIRSAIGTPLQTISSGGTSLLMIDSGSGDNLFAVDV RGIDPEEGRFNNLRLIVERNNLYVTGFVNRTNNVFY RFADFSHVTFPGTTAVTLSGDSSYTTLQRVAGISRTG MQINRHSLTTSYLDLMSHSGTSLTQSVARAMLRFVT VTAEALRFRQIQRGFRTTLDDLSGRSYVMTAEDVDL TLNWGRLSSVLPDYHGQDSVRVGRISFGSINAILGSV ALILNSHHASAVAA |
| SEQ ID NO: 213 | multivalent CD20-binding molecule component 167 | QVQLQQPGAELVKPGASVKMSCKASGYTFTSYNM HWVKQTPGRGLEWIGAIYPGNGDTSYNQKFKGKAT LTADKSSSTAYMQLSSLTSEDSAVYYCARSTYYGG DWYFNVWGAGTTVTVSAGSTSGSGKPGSGEGSTKG QIVLSQSPAILSASPGEKVTMTCRASSSVSYIHWFQQ KPGSSPKPWIYATSNLASGVPVRFSGSGSGTSYSLTIS RVEAEDAATYYCQQWTSNPPTFGGGTKLEIKEFPKP STPPGSSGGAPKEFTLDFSTAKTYVDSLNVIRSAIGTP LQTISSGGTSLLMIDSGSGDNLFAVDVRGIDPEEGRF NNLRLIVERNNLYVTGFVNRTNNVFYRFADFSHVTF PGTTAVTLSGDSSYTTLQRVAGISRTGMQINRHSLTT SYLDLMSHSGTSLTQSVARAMLRFVTVTAEALRFR QIQRGFRTTLDDLSGRSYVMTAEDVDLTLNWGRLS SVLPDYHGQDSVRVGRISFGSINAILGSVALILNSHH HASRVAR |
| SEQ ID NO: 214 | multivalent CD20-binding molecule component 168 | QVQLQQPGAELVKPGASVKMSCKASGYTFTSYNM HWVKQTPGRGLEWIGAIYPGNGDTSYNQKFKGKAT LTADKSSSTAYMQLSSLTSEDSAVYYCARSTYYGG DWYFNVWGAGTTVTVSAGGGGSGGGGSGGGGSG GGGSGGGGSTKGQIVLSQSPAILSASPGEKVTMTCR ASSSVSYIHWFQQKPGSSPKPWIYATSNLASGVPVRF SGSGSGTSYSLTISRVEAEDAATYYCQQWTSNPPTF GGGTKLEIKGGGGSGGKEFTLDFSTAKTYVDSLNVI RSAIGTPLQTISSGGTSLLMIDSGSGDNLFAVDVRGI DPEEGRFNNLRLIVERNNLYVTGFVNRTNNVFYRFA DFSHVTFPGTTAVTLSGDSSYTTLQRVAGISRTGMQI NRHSLTTSYLDLMSHSGTSLTQSVARAMLRFVTVTA EALRFRQIQRGFRTTLDDLSGRSYVMTAEDVDLTLN WGRLSSVLPDYHGQDSVRVGRISFGSINAILGSVALI LNSHHASRVAR |
| SEQ ID NO: 215 | multivalent CD20-binding molecule component 169 | QVQLQQPGAELVKPGASVKMSCKASGYTFTSYNM HWVKQTPGRGLEWIGAIYPGNGDTSYNQKFKGKAT LTADKSSSTAYMQLSSLTSEDSAVYYCARSTYYGG DWYFNVWGAGTTVTVSAGGGGSTKGQIVLSQSPAI LSASPGEKVTMTCRASSSVSYIHWFQQKPGSSPKPW IYATSNLASGVPVRFSGSGSGTSYSLTISRVEAEDAA TYYCQQWTSNPPTFGGGTKLEIKGGGGSGGKEFPKP FSTAKTYVDSLNVIRSAIGTPLQTISSGGTSLLMIDSG TGDNLFAVDVRGIDPEEGRFNNLRLIVERNNLYVTG FVNRTNNVFYRFADFSHVTFPGTTAVTLSGDSSYTT LQRVAGISRTGMQINRHSLTTSYLDLMSHSGTSLTQ |

| | | |
|---|---|---|
| | | SVARAMLRFVTVTAEALRFRQIQRGFRTTLDDLSGR<br>SYVMTAEDVDLTLNWGRLSSVLPDYHGQDSVRVG<br>RISFGSINAILGSVALILNSHHHASRVAR |
| SEQ ID NO: 216 | multivalent CD20-<br>binding molecule<br>component 170 | QVQLQQPGAELVKPGASVKMSCKASGYTFTSYNM<br>HWVKQTPGRGLEWIGAIYPGNGDTSYNQKFKGKAT<br>LTADKSSSTAYMQLSSLTSEDSAVYYCARSTYYGG<br>DWYFNVWGAGTTVTVSAGSTSGSGKPGSGEGSTKG<br>QIVLSQSPAILSASPGEKVTMTCRASSSVSYIHWFQQ<br>KPGSSPKPWIYATSNLASGVPVRFSGSGSGTSYSLTIS<br>RVEAEDAATYYCQQWTSNPPTFGGGTKLEIKEFPKP<br>STPPGSSGGAPKEFTLDFSTAKTYVDSLNVIRSAIGTP<br>LQTISSGGTSLLMIDSGSGDNLFAVDVRGIDPEEGRF<br>NNLRLIVERNNLYVTGFVNRTNNVFYRFADFSHVTF<br>PGTTAVTLSGDSSYTTLQRVAGISRTGMQINRHSLTT<br>SYLDLMSHSGTSLTQSVARAMLRFVTVTAEALRFR<br>QIQRGFRTTLDDLSGRSYVMTAEDVDLTLNWGRLS<br>SVLPDYHGQDSVRVGRISFGSINAILGSVALILNSHH<br>HAS |
| SEQ ID NO: 217 | multivalent CD20-<br>binding molecule<br>component 171 | QVQLQQPGAELVKPGASVKMSCKASGYTFTSYNM<br>HWVKQTPGRGLEWIGAIYPGNGDTSYNQKFKGKAT<br>LTADKSSSTAYMQLSSLTSEDSAVYYCARSTYYGG<br>DWYFNVWGAGTTVTVSAGSTSGSGKPGSGEGSTKG<br>QIVLSQSPAILSASPGEKVTMTCRASSSVSYIHWFQQ<br>KPGSSPKPWIYATSNLASGVPVRFSGSGSGTSYSLTIS<br>RVEAEDAATYYCQQWTSNPPTFGGGTKLEIKEFPKP<br>STPPGSSGGAPKEFTLDFSTAKTYVDSLNVIRSAIGTP<br>LQTISSGGTSLLMIDSGSGDNLFAVDVRGIDPEEGRF<br>NNLRLIVERNNLYVTGFVNRTNNVFYRFADFSHVTF<br>PGTTAVTLSGDSSYTTLQRVAGISRTGMQINRHSLTT<br>SYLDLMSHSGTSLTQSVARAMLRFVTVTAEALRFR<br>QIQRGFRTTLDDLSGRSYVMTAEDVDLTLNWGRLS<br>SVLPDYHGQDSVRVGRISFGSINAILGSVALILNSHH<br>HASRVAR |
| SEQ ID NO: 218 | multivalent CD20-<br>binding molecule<br>component 172 | QVQLQQPGAELVKPGASVKMSCKASGYTFTSYNM<br>HWVKQTPGRGLEWIGAIYPGNGDTSYNQKFKGKAT<br>LTADKSSSTAYMQLSSLTSEDSAVYYCARSTYYGG<br>DWYFNVWGAGTTVTVSAGSTSGSGKPGSGEGSTKG<br>QIVLSQSPAILSASPGEKVTMTCRASSSVSYIHWFQQ<br>KPGSSPKPWIYATSNLASGVPVRFSGSGSGTSYSLTIS<br>RVEAEDAATYYCQQWTSNPPTFGGGTKLEIKEFPKP<br>STPPGSSGGAPGILGFVFTLKEFTLDFSTAKTYVDSL<br>NVIRSAIGTPLQTISSGGTSLLMIDSGSGDNLFAVDV<br>RGIDPEEGRFNNLRLIVERNNLYVTGFVNRTNNVFY<br>RFADFSHVTFPGTTAVTLSGDSSYTTLQRVAGISRTG<br>MQINRHSLTTSYLDLMSHSGTSLTQSVARAMLRFVT<br>VTAEALRFRQIQRGFRTTLDDLSGRSYVMTAEDVDL<br>TLNWGRLSSVLPDYHGQDSVRVGRISFGSINAILGSV<br>ALILNSHHHAS |
| SEQ ID NO: 219 | multivalent CD20-<br>binding molecule<br>component 173 | EIVLTQSPATLSLSGERATLSCRASQSVSSYLAWYQ<br>QKPGQAPRLLIYDASNRATGIPARFSGSGSGTDFTLT<br>ISSLEPEDFAVYYCQQRSNWPITFGQGTRLEIKGSTS<br>GSGLPGSGEGSEVQLVESGGGLVQPGRSLRLSCAAS<br>GFTFNDYAMHWVRQAPGKGLEWVSTISWNSGSIGY<br>ADSVKGRFTISRDNAKKSLYLQMNSLRAEDTALYY<br>CAKDIQYGNYYYGMDVWGQGTTVTVSSEFPKPSTP<br>PGSSGGKEFTLDFSTAKTYVDSLNVIRSAIGTPLQ<br>TISSGGTSLLMIDSGSGDNLFAVDVRGIDPEEGRFNN<br>LRLIVERNNLYVTGFVNRTNNVFYRFADFSHVTFPG<br>TTAVTLSGDSSYTTLQRVAGISRTGMQINRHSLTTSY<br>LDLMSHSGTSLTQSVARAMLRFVTVTAEALRFRQIQ<br>RGFRTTLDDLSGASYVMTAEDVDLTLNWGRLSSVL<br>PDYHGQDSVRVGRISFGSINAILGSVALILNSHHHAS<br>RVAR |
| SEQ ID NO: 220 | multivalent CD20-<br>binding molecule<br>component 174 | EIVLTQSPATLSLSGERATLSCRASQSVSSYLAWYQ<br>QKPGQAPRLLIYDASNRATGIPARFSGSGSGTDFTLT<br>ISSLEPEDFAVYYCQQRSNWPITFGQGTRLEIKGGGG<br>SEVQLVESGGGLVQPGRSLRLSCAASGFTFNDYAM<br>HWVRQAPGKGLEWVSTISWNSGSIGYADSVKGRFTI<br>SRDNAKKSLYLQMNSLRAEDTALYYCAKDIQYGNY<br>YYGMDVWGQGTTVTVSSEFPKPSTPPGSSGGKEF |

| ID Number | Text Description | Biological Sequence |
|---|---|---|
| | | TLDFSTAKTYVDSLNVIRSAIGTPLQTISSGGTSLLMI DSGSGDNLFAVDVRGIDPEEGRFNNLRLIVERNNLY VTGFVNRTNNVFYRFADFSHVTFPGTTAVTLSGDSS YTTLQRVAGISRTGMQINRHSLTTSYLDLMSHSGTS LTQSVARAMLRFVTVTAEALRFRQIQRGFRTTLDDL SGASYVMTAEDVDLTLNWGRLSSVLPDYHGQDSVR VGRISFGSINAILGSVALILNSHHHASRVAR |
| SEQ ID NO: 221 | multivalent CD20-binding molecule component 175 | EIVLTQSPATLSLSGERATLSCRASQSVSSYLAWYQ QKPGQAPRLLIYDASNRATGIPARFSGSGSGTDFTLT ISSLEPEDFAVYYCQQRSNWPITFGQGTRLEIKGSTS GSGLPGSGEGSEVQLVESGGGLVQPGRSLRLSCAAS GFTFNDYAMHWVRQAPGKGLEWVSTISWNSGSIGY ADSVKGRFTISRDNAKKSLYLQMNSLRAEDTALYY CAKDIQYGNYYYGMDVWGQGTTVTVSSEFPKPSTP PGSSSGGKEFTLDFSTAKTYVDSLNVIRSAIGTPLQ TISSGGTSLLMIDSGSGDNLFAVDVRGIDPEEGRFNN LRLIVERNNLYVTGFVNRTNNVFYRFADFSHVTFPG TTAVTLSGDSSYTTLQRVAGISRTGMQINRHSLTTSY LDLMSHSGTSLTQSVARAMLRFVTVTAEALRFRQIQ RGFRTTLDDLSGASYVMTAEDVDLTLNWGRLSSVL PDYHGQDSVRVGRISFGSINAILGSVALILNSHHHAS RVAR |
| SEQ ID NO: 222 | multivalent CD20-binding molecule component 176 | EIVLTQSPATLSLSGERATLSCRASQSVSSYLAWYQ QKPGQAPRLLIYDASNRATGIPARFSGSGSGTDFTLT ISSLEPEDFAVYYCQQRSNWPITFGQGTRLEIKGSTS GSGLPGSGEGSEVQLVESGGGLVQPGRSLRLSCAAS GFTFNDYAMHWVRQAPGKGLEWVSTISWNSGSIGY ADSVKGRFTISRDNAKKSLYLQMNSLRAEDTALYY CAKDIQYGNYYYGMDVWGQGTTVTVSSEFPKPSTP PGSSSGGKEFTLDFSTAKTYVDSLNVIRSAIGTPLQ TISSGGTSLLMIDSGSGDNLFAVDVRGIDPEEGRFNN LRLIVERNNLYVTGFVNRTNNVFYRFADFSHVTFPG TTAVTLSGDSSYTTLQRVAGISRTGMQINRHSLTTSY LDLMSHSGTSLTQSVARAMLRFVTVTAEALRFRQIQ RGFRTTLDDLSGASYVMTAEDVDLTLNWGRLSSVL PDYHGQDSVRVGRISFGSINAILGSVALILNSHHHAS RVAR |
| SEQ ID NO: 223 | multivalent CD20-binding molecule component 177 | EIVLTQSPATLSLSGERATLSCRASQSVSSYLAWYQ QKPGQAPRLLIYDASNRATGIPARFSGSGSGTDFTLT ISSLEPEDFAVYYCQQRSNWPITFGQGTRLEIKGSTS SGGGGSGGGGSGGGGSGGGGSEVQLVESGGGLVQP GRSLRLSCAASGFTFNDYAMHWVRQAPGKGLEWV STISWNSGSIGYADSVKGRFTISRDNAKKSLYLQMN SLRAEDTALYYCAKDIQYGNYYYGMDVWGQGTTV TVSSGGGGSGGKEFTLDFSTAKTYVDSLNVIRSAIGT PLQTISSGGTSLLMIDSGSGDNLFAVDVRGIDPEEGR FNNLRLIVERNNLYVTGFVNRTNNVFYRFADFSHVT FPGTTAVTLSGDSSYTTLQRVAGISRTGMQINRHSLT TSYLDLMSHSGTSLTQSVARAMLRFVTVTAEALRFR QIQRGFRTTLDDLSGASYVMTAEDVDLTLNWGRLS SVLPDYHGQDSVRVGRISFGSINAILGSVALILNSHH HASRVAR |
| SEQ ID NO: 224 | multivalent CD20-binding molecule component 178 | EIVLTQSPATLSLSGERATLSCRASQSVSSYLAWYQ QKPGQAPRLLIYDASNRATGIPARFSGSGSGTDFTLT ISSLEPEDFAVYYCQQRSNWPITFGQGTRLEIKGGGG SGGGGSGGGGSGGGGSGGGGSEVQLVESGGGLVQP GRSLRLSCAASGFTFNDYAMHWVRQAPGKGLEWV STISWNSGSIGYADSVKGRFTISRDNAKKSLYLQMN SLRAEDTALYYCAKDIQYGNYYYGMDVWGQGTTV TVSSEFPKPSTPPGSSGGAPKEFTLDFSTAKTYVDSL NVIRSAIGTPLQTISSGGTSLLMIDSGSGDNLFAVDV RGIDPEEGRFNNLRLIVERNNLYVTGFVNRTNNVFY RFADFSHVTFPGTTAVTLSGDSSYTTLQRVAGISRTG MQINRHSLTTSYLDLMSHSGTSLTQSVARAMLRFVT VTAEALRFRQIQRGFRTTLDDLSGASYVMTAEDVDL TLNWGRLSSVLPDYHGQDSVRVGRISFGSINAILGSV ALILNSHHASAVAA |
| SEQ ID NO: 225 | multivalent CD20-binding molecule component 179 | QIVLSQSPAILSASPGEKVTMTCRASSSVSYMHWYQ QKPGSSPKPWIYAPSNLASGVPARFSGSGSGTSYSLT ISRVEAEDAATYYCQQWSFNPPTFGAGTKLELKSGS |

| | | Sequence Listing |
|---|---|---|
| ID Number | Text Description | Biological Sequence |
| | | TSGSGKPGSGEGSQAYLQQSGAELVRPGASVKMSC KASGYTFTSYNMHWVKQTPRQGLEWIGAIYPGNGD TSYNQKFKGKATLTVDKSSSTAYMQLSSLTSEDSAV YFCARVVYYSNSYWYFDVWGTGTTVTVSEFPKPST PPGSSGGAPKEFTLDFSTAKTYVDSLNVIRSAIGTPL QTISSGGTSLLMIDSGSGDNLFAVDVRGIDPEEGRFN NLRLIVERNNLYVTGFVNRTNNVFYRFADFSHVTFP GTTAVTLSGDSSYTTLQRVAGISRTGMQINRHSLTTS YLDLMSHSGTSLTQSVARAMLRFVTVTAEALRFRQI QRGFRTTLDDLSGRSYVMTAEDVDLTLNWGRLSSV LPDYHGQDSVRVGRISFGSINAILGSVALILNSHHHA SRVARKDEL |
| SEQ ID NO: 226 | multivalent CD20-binding molecule component 180 | QIVLSQSPAILSASPGEKVTMTCRASSSVSYMHWYQ QKPGSSPKPWIYAPSNLASGVPARFSGSGSGTSYSLT ISRVEAEDAATYYCQQWSFNPPTFGAGTKLELKSG GGGSGGGGSGGGGSGGGGSGGGGSQAYLQQSGAEL VRPGASVKMSCKASGYTFTSYNMHWVKQTPRQGL EWIGAIYPGNGDTSYNQKFKGKATLTVDKSSSTAY MQLSSLTSEDSAVYFCARVVYYSNSYWYFDVWGT GTTVTVSGGGGSGGKEFTLDFSTAKTYVDSLNVIRS AIGTPLQTISSGGTSLLMIDSGSGDNLFAVDVRGIDPE EGRFNNLRLIVERNNLYVTGFVNRTNNVFYRFADFS HVTFPGTTAVTLSGDSSYTTLQRVAGISRTGMQINR HSLTTSYLDLMSHSGTSLTQSVARAMLRFVTVTAEA LRFRQIQRGFRTTLDDLSGRSYVMTAEDVDLTLNW GRLSSVLPDYHGQDSVRVGRISFGSINAILGSVALIL NSHHHASRVAR |
| SEQ ID NO: 227 | multivalent CD20-binding molecule component 181 | QIVLSQSPAILSASPGEKVTMTCRASSSVSYMHWYQ QKPGSSPKPWIYAPSNLASGVPARFSGSGSGTSYSLT ISRVEAEDAATYYCQQWSFNPPTFGAGTKLELKSG GGGSGGGGSGGGGSGGGGSGGGGSQAYLQQSGAEL VRPGASVKMSCKASGYTFTSYNMHWVKQTPRQGL EWIGAIYPGNGDTSYNQKFKGKATLTVDKSSSTAY MQLSSLTSEDSAVYFCARVVYYSNSYWYFDVWGT GTTVTVSGGGGSGGKEFTLDFSTAKTYVDSLNVIRS AIGTPLQTISSGGTSLLMIDSGSGDNLFAVDVRGIDP EEGRFNNLRLIVERNNLYVTGFVNRTNNVFYRFADF SHVTFPGTTAVTLSGDSSYTTLQRVAGISRTGMQINR HSLTTSYLDLMSHSGTSLTQSVARAMLRFVTVTAEA LRFRQIQRGFRTTLDDLSGRSYVMTAEDVDLTLNW GRLSSVLPDYHGQDSVRVGRISFGSINAILGSVALIL NSHHHASRVAR |
| SEQ ID NO: 228 | multivalent CD20-binding molecule component 182 | QIVLSQSPAILSASPGEKVTMTCRASSSVSYMHWYQ QKPGSSPKPWIYAPSNLASGVPARFSGSGSGTSYSLT ISRVEAEDAATYYCQQWSFNPPTFGAGTKLELKSGS TSGSGKPGSGEGSQAYLQQSGAELVRPGASVKMSC KASGYTFTSYNMHWVKQTPRQGLEWIGAIYPGNGD TSYNQKFKGKATLTVDKSSSTAYMQLSSLTSEDSAV YFCARVVYYSNSYWYFDVWGTGTTVTVSGGGGSG GKEFTLDFSTAKTYVDSLNVIRSAIGTPLQTISSGGTS LLMIDSGSGDNLFAVDVRGIDPEEGRFNNLRLIVERN NLYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHAS |
| SEQ ID NO: 229 | multivalent CD20-binding molecule component 183 | QIVLSQSPAILSASPGEKVTMTCRASSSVSYMHWYQ QKPGSSPKPWIYAPSNLASGVPARFSGSGSGTSYSLT ISRVEAEDAATYYCQQWSFNPPTFGAGTKLELKSGG GGSQAYLQQSGAELVRPGASVKMSCKASGYTFTSY NMHWVKQTPRQGLEWIGAIYPGNGDTSYNQKFKG KATLTVDKSSSTAYMQLSSLTSEDSAVYFCARVVY YSNSYWYFDVWGTGTTVTVSGGGGSGGKEFTLDFS TAKTYVDSLNVIRSAIGTPLQTISSGGTSLLMIDNLVP MVATVVDVRGIDPEEGRFNNLRLIVERNNLYVTGFV NRTNNVFYRFADFSHVTFPGTTAVTLSADSSYTTLQ RVAGISRTGMQINRHSLTTSYLDLMSHSATSLTQSV ARAMLRFVTVTAEALRFRQIQRGFRTTLDDLSGRSY VMTAEDVDLTLNWGRLSSVLPDYHGQDSVRVGRIS FGSINAILGSVALILNSHHHASRVAR |

Sequence Listing

| ID Number | Text Description | Biological Sequence |
|---|---|---|
| SEQ ID NO: 230 | multivalent CD20-binding molecule component 184 | QIVLSQSPAILSASPGEKVTMTCRASSSVSYMHWYQ QKPGSSPKPWIYAPSNLASGVPARFSGSGSGTSYSLT ISRVEAEDAATYYCQQWSFNPPTFGAGTKLELKSGS TSGSGKPGSGEGSQAYLQQSGAELVRPGASVKMSC KASGYTFTSYNMHWVKQTPRQGLEWIGAIYPGNGD TSYNQKFKGKATLTVDKSSTAYMQLSSLTSEDSAV YFCARVVYYSNSYWYFDVWGTGTTVTVSEFPKPDT PPGSSGGAPKEFTLDFSTAKTYVDSLNVIRSAIGTPL QTISSGGTSLLMIDSGSGDNLFAVDVRGIDPEEGRFN NLRLIVERNNLYVTGFVNRTNNVFYRFADFSHVTFP GTTAVTLSADSSYTTLQRVAGISRTGMQINRHSLTTS YLDLMSHSATSLTQSVARAMLRFVTVTAEALRFRQI QRGFRTTLDDLSGRSYVMTAEDVDLTLNWGRLSSV LPDYHGQDSVRVGRISFGSINAILGSVALILNSHHHA S |
| SEQ ID NO: 231 | multivalent CD20-binding molecule component 185 | QVQLQQPGAELVKPGASVKMSCKASGYTFTSYNMH WVKQTPGRGLEWIGAIYPGNGDTSYNQKFKGKATL TVDKSSSTAYMQLSSLTSEDSAVYYCARSTYYGGD WYFDVWGAGTTVTVSGSGKPGSGEGSTKGQIVLSQ SPAILSASPGEKVTMTCRASSSVSYIHWFQQKPGSS PKPWIYAPSNLASGVPARFSGSGSGTSYSLTISRVEA EDAATYYCQQWTSNPPTFGGGTKLELKEFPKPSTP PGSSGGAPKEFTLDFSTAKTYVDSLNVIRSAIGTPLQ TISSGGTSLLMIDSGSGDNLFAVDVRGIDPEEGRFNN LRLIVERNNLYVTGFVNRTNNVFYRFADFSHVTFPG TTAVTLSGDSSYTTLQRVAGISRTGMQINRHSLTTSY LDLMSHSGTSLTQSVARAMLRFVTVTAEALRFRQIQ RGFRTTLDDLSGRSYVMTAEDVDLTLNWGRLSSVL PDYHGQDSVRVGRISFGSINAILGSVALILNSHHHAS RVAR |
| SEQ ID NO: 232 | multivalent CD20-binding molecule component 186 | QAYLQQSGAELVRPGASVKMSCKASGYTFTSYNMH WVKQTPRQGLEWIGAIYPGNGDTSYNQKFKGKATL YVDKSSSTAYMQLSSLTSEDSAVYFCARVVYYSNSY WYFDVWGTGTTVTVSGSTSGSGKPGSGEGSQIVLSQ SPAILSASPGEKVTMTCRASSSVSYMHWYQQKPGSS PKPWIYAPSNLASGVPARFSGSGSGTSYSLTISRVEA EDAATYYCQQWSFNPPTFGAGTKLELKSGGGGSGG KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASRVAR |
| SEQ ID NO: 233 | multivalent CD20-binding molecule component 187 | QAYLQQSGAELVRPGASVKMSCKASGYTFTSYNMH WVKQTPRQGLEWIGAIYPGNGDTSYNQKFKGKATL YVDKSSSTAYMQLSSLTSEDSAVYFCARVVYYSNSY WYFDVWGTGTTVTVSGSTSGSGKPGSGEGSQIVLSQ SPAILSASPGEKVTMTCRASSSVSYMHWYQQKPGSS PKPWIYAPSNLASGVPARFSGSGSGTSYSLTISRVEA EDAATYYCQQWSFNPPTFGAGTKLELKSGGGGSGG KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASRVAR |
| SEQ ID NO: 234 | multivalent CD20-binding molecule component 188 | QAYLQQSGAELVRPGASVKMSCKASGYTFTSYNMH WVKQTPRQGLEWIGAIYPGNGDTSYNQKFKGKATL YVDKSSSTAYMQLSSLTSEDSAVYFCARVVYYSNSY WYFDVWGTGTTVTVSGGGGSQIVLSQSPAILSASPG EKVTMTCRASSSVSYMHWYQQKPGSSPKPWIYAPS NLASGVPARFSGSGSGTSYSLTISRVEAEDAATYYC QQWSFNPPTFGAGTKLELKSGGGGSGGKEFTLDFST AKTYVDSLNVIRSAIGTPLQTISSGGTSLLMIDSGSGD NLFAVDVRGIDPEEGRFNNLRLIVERNNLYVTGFVN RTNNVFYRFADFSHVTFPGTTAVTLSGDSSYTTLQR VAGISRTGMQINRHSLTTSYLDLMSHSGTSLTQSVA RAMLRFVTVTAEALRFRQIQRGFRTTLDDLSGRSYV MTAEDVDLTLNWGRLSSVLPDYHGQDSVRVGRISF GSINAILGSVALILNSHHHASRVAR |

| | | Sequence Listing |
|---|---|---|
| ID Number | Text Description | Biological Sequence |
| SEQ ID NO: 235 | multivalent CD20-binding molecule component 189 | QAYLQQSGAELVRPGASVKMSCKASGYTFTSYNMH WVKQTPRQGLEWIGAIYPGNGDTSYNQKFKGKATL YVDKSSSTAYMQLSSLTSEDSAVYFCARVVYYSNSY WYFDVWGTGTTVTVSGGGGSGGGGSGGGGSGGGG SGGGGSQIVLSQSPAILSASPGEKVTMTCRASSSVSY MHWYQQKPGSSPKPWIYAPSNLASGVPARFSGSGS GTSYSLTISRVEAEDAATYYCQQWSFNPPTFGAGTK LELKSKEFPKPSTPPGSSGGAPKEFTLDFSTAKTYVDS LNVIRSAIGTPLQTISSGGTSLLMIDNLVPMVATVVD VRGIDPEEGRFNNLRLIVERNNLYVTGFVNRTNNVF YRFADFSHVTFPGTTAVTLSGDSSYTTLQRVAGISRT GMQINRHSLTTSYLDLMSHSGTSLTQSVARAMLRFV TVTAEALRFRQIQRGFRTTLDDLSGRSYVMTAEDVD LTLNWGRLSSVLPDYHGQDSVRVGRISFGSINAILGS VALILNSHHASRVARKDEL |
| SEQ ID NO: 236 | multivalent CD20-binding molecule component 190 | QAYLQQSGAELVRPGASVKMSCKASGYTFTSYNMH WVKQTPRQGLEWIGAIYPGNGDTSYNQKFKGKATL YVDKSSSTAYMQLSSLTSEDSAVYFCARVVYYSNSY WYFDVWGTGTTVTVSGGGSQIVLSQSPAILSASPG EKVTMTCRASSSVSYMHWYQQKPGSSPKPWIYAPS NLASGVPARFSGSGSGTSYSLTISRVEAEDAATYYC QQWSFNPPTFGAGTKLELKSGGGGSGGKEFTLDFST AKTYVDSLNVIRSAIGTPLQTISSGGTSLLMIDSGSGD NLFAVDVRGIDPEEGRFNNLRLIVERNNLYVTGFVN RTNNVFYRFADFSHVTFPGTTAVTLSGDSSYTTLQR VAGISRTGMQINRHSLTTSYLDLMSHSGTSLTQSVA RAMLRFVTVTAEALRFRQIQRGFRTTLDDLSGRSYV MTAEDVDLTLNWGRLSSVLPDYHGQDSVRVGRISF GSINAILGSVALILNSHHASAVAA |
| SEQ ID NO: 237 | multivalent CD20-binding molecule component 191 | QAYLQQSGAELVRPGASVKMSCKASGYTFTSYWIN WVRQAPRQGLEWMGRIYPGDGDTDYNGKFKGRVT ITADKSTSTAYMELSSLRSEDTAVYYCARNVFDGY WLVYWGQGTLVTVSSGSTSGSGKPGSGEGSDIVMT QTPLSLPVTPGEPASISCRSSKSLLHSNGITYLYWYL QKPGQSPQLLIYQMSNLVSGVPDRFSGSGSGTDFTL KISRVEAEDVGVYYCAQNLELPYTFGGGTKVEIKEF PKPSTPPGSSGGAPKEFTLDFSTAKTYVDSLNVIRSAI GTPLQTISSGGTSLLMIDSGSGDNLFAVDVRGIDPEE GRFNNLRLIVERNNLYVTGFVNRTNNVFYRFADFSH VTFPGTTAVTLSGDSSYTTLQRVAGISRTGMQINRHS LTTSYLDLMSHSGTSLTQSVARAMLRFVTVTAEALR FRQIQRGFRTTLDDLSGRSYVMTAEDVDLTLNWGR LSSVLPDYHGQDSVRVGRISFGSINAILGSVALILNSH HHASRVAR |
| SEQ ID NO: 238 | multivalent CD20-binding molecule component 192 | QAYLQQSGAELVRPGASVKMSCKASGYTFTSYWIN WVRQAPRQGLEWMGRIYPGDGDTDYNGKFKGRVT ITADKSTSTAYMELSSLRSEDTAVYYCARNVFDGY WLVYWGQGTLVTVSSGSTSGSGKPGSGEGSDIVMT QTPLSLPVTPGEPASISCRSSKSLLHSNGITYLYWYL QKPGQSPQLLIYQMSNLVSGVPDRFSGSGSGTDFTL KISRVEAEDVGVYYCAQNLELPYTFGGGTKVEIKEF PKPSTPPGSSGGAPGILGFVFTLKEFTLDFSTAKTYV DSLNVIRSAIGTPLQTISSGGTSLLMIDSGSGDNLFAV DVRGIDPEEGRFNNLRLIVERNNLYVTGFVNRTNNV FYRFADFSHVTFPGTTAVTLSGDSSYTTLQRVAGISR TGMQINRHSLTTSYLDLMSHSGTSLTQSVARAMLRF VTVTAEALRFRQIQRGFRTTLDDLSGRSYVMTAEDV DLTLNWGRLSSVLPDYHGQDSVRVGRISFGSINAILG SVALILNSHHASRVAR |
| SEQ ID NO: 239 | multivalent CD20-binding molecule component 193 | QAYLQQSGAELVRPGASVKMSCKASGYTFTSYWIN WVRQAPRQGLEWMGRIYPGDGDTDYNGKFKGRVT ITADKSTSTAYMELSSLRSEDTAVYYCARNVFDGY WLVYWGQGTLVTVSSGGGGSDIVMTQTPLSLPVTP GEPASISCRSSKSLLHSNGITYLYWYLQKPGQSPQLL IYQMSNLVSGVPDRFSGSGSGTDFTLKISRVEAEDV GVYYCAQNLELPYTFGGGTKVEIKEFPKPSTPPGSSG GAPGILGFVFTLKEFTLDFSTAKTYVDSLNVIRSAIGT PLQTISSGGTSLLMIDSGSGDNLFAVDVRGIDPEEGR FNNLRLIVERNNLYVTGFVNRTNNVFYRFADFSHVT FPGTTAVTLSGDSSYTTLQRVAGISRTGMQINRHSLT |

| Sequence Listing | | |
|---|---|---|
| ID Number | Text Description | Biological Sequence |
| | | TSYLDLMSHSGTSLTQSVARAMLRFVTVTAEALRFR QIQRGFRTTLDDLSGRSYVMTAEDVDLTLNWGRLS SVLPDYHGQDSVRVGRISFGSINAILGSVALILNSHH HASRVAR |
| SEQ ID NO: 240 | multivalent CD20-binding molecule component 194 | QAYLQQSGAELVRPGASVKMSCKASGYTFTSYWIN WVRQAPRQGLEWMGRIYPGDGDTDYNGKFKGRVT ITADKSTSTAYMELSSLRSEDTAVYYCARNVFDGY WLVYWGQGTLVTVSSGGGGSDIVMTQTPLSLPVTP GEPASISCRSSKSLLHSNGITYLYWYLQKPGQSPQLL IYQMSNLVSGVPDRFSGSGSGTDFTLKISRVEAEDV GVYYCAQNLELPYTFGGGTKVEIKEFPKPSTPPGSSG GAPGILGFVFTLKEFTLDFSTAKTYVDSLNVIRSAIGT PLQTISSGGTSLLMIDSGSGDNLFAVDVRGIDPEEGR FNNLRLIVERNNLYVTGFVNRTNNVFYRFADFSHVT FPGTTAVTLSGDSSYTTLQRVAGISRTGMQINRHSLT TSYLDLMSHSGTSLTQSVARAMLRFVTVTAEALRFR QIQRGFRTTLDDLSGRSYVMTAEDVDLTLNWGRLS SVLPDYHGQDSVRVGRISFGSINAILGSVALILNSHH HAS |
| SEQ ID NO: 241 | multivalent CD20-binding molecule component 195 | QAYLQQSGAELVRPGASVKMSCKASGYTFTSYWIN WVRQAPRQGLEWMGRIYPGDGDTDYNGKFKGRVT ITADKSTSTAYMELSSLRSEDTAVYYCARNVFDGY WLVYWGQGTLVTVSSGGGGSDIVMTQTPLSLPVTP GEPASISCRSSKSLLHSNGITYLYWYLQKPGQSPQLL IYQMSNLVSGVPDRFSGSGSGTDFTLKISRVEAEDV GVYYCAQNLELPYTFGGGTKVEIKEFPKPSTPPGSSG GAPKEFTLDFSTAKTYVDSLNVIRSAIGTPLQTISSGG TSLLMIDSGSGDNLFAVDVRGIDPEEGRFNNLRLIV ERNNLYVTGFVNRTNNVFYRFADFSHVTFPGTTAVT LSGDSSYTTLQRVAGISRTGMQINRHSLTTSYLDLM SHSGTSLTQSVARAMLRFVTVTAEALRFRQIQRGFR TTLDDLSGRSYVMTAEDVDLTLNWGRLSSVLPDYH GQDSVRVGRISFGSINAILGSVALILNSHHHASRVAR |
| SEQ ID NO: 242 | multivalent CD20-binding molecule component 196 | QAYLQQSGAELVRPGASVKMSCKASGYTFTSYWIN WVRQAPRQGLEWMGRIYPGDGDTDYNGKFKGRVT ITADKSTSTAYMELSSLRSEDTAVYYCARNVFDGY WLVYWGQGTLVTVSSGGSTSGSGKPGEGSDIVMT QTPLSLPVTPGEPASISCRSSKSLLHSNGITYLYWYL QKPGQSPQLLIYQMSNLVSGVPDRFSGSGSGTDFTL KISRVEAEDVGVYYCAQNLELPYTFGGGTKVEIKGG GGAPSGGKEFTLDFSTAKTYVDSLNVIRSAIGTPLQTISS GGTSLLMIDSGSGDNLFAVDVRGIDPEEGRFNNLRLI VERNNLYVTGFVNRTNNVFYRFADFSHVTFPGTTA VTLSGDSSYTTLQRVAGISRTGMQINRHSLTTSYLDL MSHSGTSLTQSVARAMLRFVTVTAEALRFRQIQRGF RTTLDDLSGRSYVMTAEDVDLTLNWGRLSSVLPDY HGQDSVRVGRISFGSINAILGSVALILNSHHHAS |
| SEQ ID NO: 243 | multivalent CD20-binding molecule component 197 | DIVMTQTPLSLPVTPGEPASISCRSSKSLLHSNGITYL YWYLQKPGQSPQLLIYQMSNLVSGVPDRFSGSGSGT DFTLKISRVEAEDVGVYYCAQNLELPYTFGGGTKVE IKGSTSGSGKPGSGEGSQVQLVQSGAEVKKPGSSVK VSCKASGYAFSYSWINWVRQAPGQGLEWMGRIFPG DGDTDYNGKFKGRVTITADKSTSTAYMELSSLRSED TAVYYCARNVFDGYWLVYWGQGTLVTVSSEFPKPS TPPGSSGGAPKEFTLDFSTAKTYVDSLNVIRSAIGTPL QTISSGGTSLLMIDSGSGDNLFAVDVRGIDPEEGRFN NLRLIVERNNLYVTGFVNRTNNVFYRFADFSHVTFP GTTAVTLSGDSSYTTLQRVAGISRTGMQINRHSLTTS YLDLMSHSGTSLTQSVARAMLRFVTVTAEALRFRQI QRGFRTTLDDLSGRSYVMTAEDVDLTLNWGRLSSV LPDYHGQDSVRVGRISFGSINAILGSVALILNSHHHA SRVAR |
| SEQ ID NO: 244 | multivalent CD20-binding molecule component 198 | DIVMTQTPLSLPVTPGEPASISCRSSKSLLHSNGITYL YWYLQKPGQSPQLLIYQMSNLVSGVPDRFSGSGSGT DFTLKISRVEAEDVGVYYCAQNLELPYTFGGGTKVE IKGGGGSQVQLVQSGAEVKKPGSSVKVSCKASGYA FSYSWINWVRQAPGQGLEWMGRIFPGDGDTDYNG KFKGRVTITADKSTSTAYMELSSLRSEDTAVYYCAR NVFDGYWLVYWGQGTLVTVSSEFPKPSTPPGSSGG APGILGFVFTLKEFTLDFSTAKTYVDSLNVIRSAIGTP |

| | Sequence Listing | |
|---|---|---|
| ID Number | Text Description | Biological Sequence |
| | | LQTISSGGTSLLMIDSGSGDNLFAVDVRGIDPEEGRF<br>NNLRLIVERNNLYVTGFVNRTNNVFYRFADFSHVTF<br>PGTTAVTLSGDSSYTTLQRVAGISRTGMQINRHSLTT<br>SYLDLMSHSGTSLTQSVARAMLRFVTVTAEALRFR<br>QIQRGFRTTLDDLSGRSYVMTAEDVDLTLNWGRLS<br>SVLPDYHGQDSVRVGRISFGSINAILGSVALILNSHH<br>HASRVARKDEL |
| SEQ ID NO: 245 | multivalent CD20-<br>binding molecule<br>component 199 | DIVMTQTPLSLPVTPGEPASISCRSSKSLLHSNGITYL<br>YWYLQKPGQSPQLLIYQMSNLVSGVPDRFSGSGSGT<br>DFTLKISRVEAEDVGVYYCAQNLELPYTFGGGTKVE<br>IKGSTSGSGKPGSGEGSQVQLVQSGAEVKKPGSSVK<br>VSCKASGYAFSYSWINWVRQAPGQGLEWMGRIFPG<br>DGDTDYNGKFKGRVTITADKSTSTAYMELSSLRSED<br>TAVYYCARNVFDGYWLVYWGQGTLVTVSSEFPKPS<br>TPPGSSGGAPGILGFVFTLKEFTLDFSTAKTYVDSLN<br>VIRSAIGTPLQTISSGGTSLLMIDSGSGDNLFAVDVR<br>GIDPEEGRFNNLRLIVERNNLYVTGFVNRTNNVFYR<br>FADFSHVTFPGTTAVTLSGDSSYTTLQRVAGISRTG<br>MQINRHSLTTSYLDLMSHSGTSLTQSVARAMLRFVT<br>VTAEALRFRQIQRGFRTTLDDLSGRSYVMTAEDVDL<br>TLNWGRLSSVLPDYHGQDSVRVGRISFGSINAILGSV<br>ALILNSHHHASRVAR |
| SEQ ID NO: 246 | multivalent CD20-<br>binding molecule<br>component 200 | DIVMTQTPLSLPVTPGEPASISCRSSKSLLHSNGITYL<br>YWYLQKPGQSPQLLIYQMSNLVSGVPDRFSGSGSGT<br>DFTLKISRVEAEDVGVYYCAQNLELPYTFGGGTKVE<br>IKGSTSGSGKPGSGEGSQVQLVQSGAEVKKPGSSVK<br>VSCKASGYAFSYSWINWVRQAPGQGLEWMGRIFPG<br>DGDTDYNGKFKGRVTITADKSTSTAYMELSSLRSED<br>TAVYYCARNVFDGYWLVYWGQGTLVTVSSEFPKPS<br>TPPGSSGGAPGILGFVFTLKEFTLDFSTAKTYVDSLN<br>VIRSAIGTPLQTISSGGTSLLMIDSGSGDNLFAVDVR<br>GIDPEEGRFNNLRLIVERNNLYVTGFVNRTNNVFYR<br>FADFSHVTFPGTTAVTLSGDSSYTTLQRVAGISRTG<br>MQINRHSLTTSYLDLMSHSGTSLTQSVARAMLRFVT<br>VTAEALRFRQIQRGFRTTLDDLSGRSYVMTAEDVDL<br>TLNWGRLSSVLPDYHGQDSVRVGRISFGSINAILGSV<br>ALILNSHHHASRVAR |
| SEQ ID NO: 247 | multivalent CD20-<br>binding molecule<br>component 201 | DIVMTQTPLSLPVTPGEPASISCRSSKSLLHSNGITYL<br>YWYLQKPGQSPQLLIYQMSNLVSGVPDRFSGSGSGT<br>DFTLKISRVEAEDVGVYYCAQNLELPYTFGGGTKVE<br>IKGGGGSQVQLVQSGAEVKKPGSSVKVSCKASGYA<br>FSYSWINWVRQAPGQGLEWMGRIFPGDGDTDYNG<br>KFKGRVTITADKSTSTAYMELSSLRSEDTAVYYCAR<br>NVFDGYWLVYWGQGTLVTVSSEFPKPSTPPGSSGG<br>APKEFTLDFSTAKTYVDSLNVIRSAIGTPLQTISSGGT<br>SLLMIDSGSGDNLFAVDVRGIDPEEGRFNNLRLIVE<br>RNNLYVTGFVNRTNNVFYRFADFSHVTFPGTTAVTL<br>SGDSSYTTLQRVAGISRTGMQINRHSLTTSYLDLMS<br>HSGTSLTQSVARAMLRFVTVTAEALRFRQIQRGFRT<br>TLDDLSGRSYVMTAEDVDLTLNWGRLSSVLPDYHG<br>QDSVRVGRISFGSINAILGSVALILNSHHHASRVAR |
| SEQ ID NO: 248 | multivalent CD20-<br>binding molecule<br>component 202 | DIVMTQTPLSLPVTPGEPASISCRSSKSLLHSNGITYL<br>YWYLQKPGQSPQLLIYQMSNLVSGVPDRFSGSGSGT<br>DFTLKISRVEAEDVGVYYCAQNLELPYTFGGGTKVE<br>IKGGGGSGGGGSGGGGSGGGGSGGGGSQVQLVQSG<br>AEVKKPGSSVKVSCKASGYAFSYSWINWVRQAPGQ<br>GLEWMGRIFPGDGDTDYNGKFKGRVTITADKSTST<br>AYMELSSLRSEDTAVYYCARNVFDGYWLVYWGQG<br>TLVTVSSGGGGSGGKEFTLDFSTAKTYVDSLNVIRS<br>AIGTPLQTISSGGTSLLMIDSGSGDNLFAVDVRGIDPE<br>EGRFNNLRLIVERNNLYVTGFVNRTNNVFYRFADFS<br>HVTFPGTTAVTLSGDSSYTTLQRVAGISRTGMQINR<br>HSLTTSYLDLMSHSGTSLTQSVARAMLRFVTVTAEA<br>LRFRQIQRGFRTTLDDLSGRSYVMTAEDVDLTLNW<br>GRLSSVLPDYHGQDSVRVGRISFGSINAILGSVALIL<br>NSHHHASAVAA |
| SEQ ID NO: 249 | multivalent CD20-<br>binding molecule<br>component 203 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS |

| Sequence Listing | | |
|---|---|---|
| ID Number | Text Description | Biological Sequence |
| | | GTSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHASRVAREFP KPSTPPGSSGGAPQAYLQQSGAELVRPGASVKMSCK ASGYTFTSYNMHWVKQTPRQGLEWIGAIYPGNGDT SYNQKFKGKATLYVDKSSSTAYMQLSSLTSEDSAVY FCARVVYYSNSYWYFDVWGTGTTVTVSGGGGSGG GGSGGGGSGGGGSGGGGSQIVLSQSPAILSASPGEK VTMTCRASSSVSYMHWYQQKPGSSPKPWIYAPSNL ASGVPARFSGSGSGTSYSLTISRVEAEDAATYYCQQ WSFNPPTFGAGTKLELKS |
| SEQ ID NO: 250 | multivalent CD20-binding molecule component 204 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHASRVAREFP KPSTPPGSSGGAPQAYLQQSGAELVRPGASVKMSCK ASGYTFTSYNMHWVKQTPRQGLEWIGAIYPGNGDT SYNQKFKGKATLYVDKSSSTAYMQLSSLTSEDSAVY FCARVVYYSNSYWYFDVWGTGTTVTVSGGGGSGG GGSGGGGSGGGGSGGGGSQIVLSQSPAILSASPGEK VTMTCRASSSVSYMHWYQQKPGSSPKPWIYAPSNL ASGVPARFSGSGSGTSYSLTISRVEAEDAATYYCQQ WSFNPPTFGAGTKLELKS |
| SEQ ID NO: 251 | multivalent CD20-binding molecule component 205 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHASRVAREFP KPSTPPGSSGGAPQAYLQQSGAELVRPGASVKMSCK ASGYTFTSYNMHWVKQTPRQGLEWIGAIYPGNGDT SYNQKFKGKATLYVDKSSSTAYMQLSSLTSEDSAVY FCARVVYYSNSYWYFDVWGTGTTVTVSGGGGSQIV LSQSPAILSASPGEKVTMTCRASSSVSYMHWYQQKP GSSPKPWIYAPSNLASGVPARFSGSGSGTSYSLTISR VEAEDAATYYCQQWSFNPPTFGAGTKLELKS |
| SEQ ID NO: 252 | multivalent CD20-binding molecule component 206 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHASRVARGG GGSGGQAYLQQSGAELVRPGASVKMSCKASGYTFT SYNMHWVKQTPRQGLEWIGAIYPGNGDTSYNQKFK GKATLYVDKSSSTAYMQLSSLTSEDSAVYFCARVV YYSNSYWYFDVWGTGTTVTVSGGGGSGGGGSGGG GSGGGGSGGGGSQIVLSQSPAILSASPGEKVTMTCR ASSSVSYMHWYQQKPGSSPKPWIYAPSNLASGVPA RFSGSGSGTSYSLTISRVEAEDAATYYCQQWSFNPPT FGAGTKLELKS |
| SEQ ID NO: 253 | multivalent CD20-binding molecule component 207 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHASRVARGG GGSGGQAYLQQSGAELVRPGASVKMSCKASGYTFT SYNMHWVKQTPRQGLEWIGAIYPGNGDTSYNQKFK GKATLYVDKSSSTAYMQLSSLTSEDSAVYFCARVV YYSNSYWYFDVWGTGTTVTVSGSTSGSGKPSGEG SQIVLSQSPAILSASPGEKVTMTCRASSSVSYMHWY QQKPGSSPKPWIYAPSNLASGVPARFSGSGSGTSYSL TISRVEAEDAATYYCQQWSFNPPTFGAGTKLELKS |

-continued

| ID Number | Text Description | Biological Sequence |
|---|---|---|
| SEQ ID NO: 254 | multivalent CD20-binding molecule component 208 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHASRVAREFP KPSTPPGSSGGAPQAYLQQSGAELVRPGASVKMSC KTSGYTFTSYNMHWVKQTPRQGLEWIGAIYPGNGD TSYNQKFKGKATLYVDKSSSTAYMQLSSLTSEDSAV YYCARVVSNYYGSSYWFFDVWGAGTTVTVSSGGGG SGGGGSGGGGSGGGGSGGGGSQIVLSQSPAILSASPG EKVTMTCRASSSVSYMDWYQQKPGSSPKPWIYATS NLASGVPARFSGSGSGTSYSLTISRVEAEDAATYYC QQWSFNPPTFGAGTKLELK |
| SEQ ID NO: 255 | multivalent CD20-binding molecule component 209 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHASRVAREFP KPSTPPGSSGGAPQAYLQQSGAELVRPGASVKMSC KTSGYTFTSYNMHWVKQTPRQGLEWIGAIYPGNGD TSFNQKFKGKATLYVDKSSSTAYMQLSSLTSEDSAV YYCARVVSNYYGSSYWFFDVWGAGTTVTVSSGSTSG SGLPGSGEGSQIVLSQSPAILSASPGEKVTMTCRASSS VSYMDWYQQKPGSSPKPWIYATSNLASGVPARFSG SGSGTSYSLTISRVEAEDAATYYCQQWSFNPPTFGAG TKLELK |
| SEQ ID NO: 256 | multivalent CD20-binding molecule component 210 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHASRVAREFP KPSTPPGSSGGAPQVQLQQSGAELVRPGASVKMSC KTSGYTFTSYNMHWVKQTPRQGLEWIGAIYPGNGD TSFNQKFKGKATLTADKSSSTVYMQLSSLTSEDSAV YYCARSNYYGSSYWFFDVWGAGTTVTVSSGGGG SQIVLSQSPAILSASPGEKVTMTCRASSSVSYMHWY QQKPGSSPKPWIYAPSNLASGVPARFSGSGSGTSYSL TISRVEAEDAATYYCQQWSFNPPTFGAGTKLELK |
| SEQ ID NO: 257 | multivalent CD20-binding molecule component 211 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHASRVARGG GGSGGQAYLQQSGAELVRPGASVKMSCKASGYTFT SYNMHWVKQTPRQGLEWIGAIYPGNGDTSYNQKFK GKATLYVDKSSSTAYMQLSSLTSEDSAVYFCARSN YYGSSYWFFDVWGAGTTVTVSSGGGGSGGGGS GGGSGGGGSGGGGSQIVLSQSPAILSASPGEKVTMT CRASSSVSYMHWYQQKPGSSPKPWIYAPSNLASGV PARFSGSGSGTSYSLTISRVEAEDAATYYCQQWSFNP PTFGAGTKLELK |
| SEQ ID NO: 258 | multivalent CD20-binding molecule component 212 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHASRVARGG GGSGGQAYLQQSGAELVRPGASVKMSCKASGYTFT SYNMHWVKQTPRQGLEWIGAIYPGNGDTSYNQKFK GKATLYVDKSSSTAYMQLSSLTSEDSAVYFCARSN YYGSSYWFFDVWGAGTTVTVSSGSTSGSGKPGSG EGSQIVLSQSPTILSASPGEKVTMTCRASSSVSYMHW |

| Sequence Listing | | |
|---|---|---|
| ID Number | Text Description | Biological Sequence |
| | | YQQKPGSSPKPWIYAPSNLASGVPARFSGSGSGTSY<br>SLTISRVEAEDAATYYCQQWSFNPPTFGAGTKLELK |
| SEQ ID NO: 259 | multivalent CD20-<br>binding molecule<br>component 213 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>ATSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNSHHHASRVARGG<br>GGSGGQAYLQQSGAELVRPGASVKMSCKASGYTFT<br>SYNMHWVKQTPRQGLEWIGAIYPGNGDTSYNQKFK<br>GKATLYVDKSSSTAYMQLSSLTSEDSAVYFCARSN<br>YYGSSYVWFFDVWGAGTTVTVSSGGGGEGSQIVLSQS<br>PTILSASPGEKVTMTCRASSSVSYMHWYQQKPGSSP<br>KPWIYAPSNLASGVPARFSGSGSGTSYSLTISRVEAE<br>DAATYYCQQWSFNPPTFGAGTKLELK |
| SEQ ID NO: 260 | multivalent CD20-<br>binding molecule<br>component 214 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>ATSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNSHHHASEFPKPST<br>PPGDDGGAPQVQLQQPSGAELVRPGASVKMSCKTSG<br>YTFTSYNMHWVKQTPRQGLEWIGAIYPGNGDTSFN<br>QKFKGKATLYVDKSSSTAYMQLSSLTSEDSAVYFC<br>ARSNYYGSSYVWFFDVWGAGTTVTVSSGGGGSGG<br>GGSGGGGSGGGGSGGGGSQIVLSQSPAILSASPGEK<br>VTMTCRASSSVSYMHWYQQKPGSSPKPWIYAPSNL<br>ASGVPARFSGSGSGTSYSLTISRVEAEDAATYYCQQ<br>WISNPPTFGAGTKLELK |
| SEQ ID NO: 261 | multivalent CD20-<br>binding molecule<br>component 215 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNSHHHASRVAREFP<br>KPSTPPGSSGGAPQVQLQQSGAELVRPGASVKMSC<br>TSGYTFTSYNMHWVKQTPRQGLEWIGAIYPGNGD<br>TSYNQKFKGKATLTADKSSSTVYMQLSSLTSEDSAV<br>YYCARSNYYGSSYVWFFDVWGAGTTVTVSSGSTSG<br>SGKPGSGEGSQIVLSQSPTILSASPGEKVTMTCRASSS<br>VSYMHWYQQKPGSSPKPWIYAPSNLASGVPARFSG<br>SGSGTSYSLTISRVEAEDAATYYCQQWSFNPPTFGAG<br>TKLELK |
| SEQ ID NO: 262 | multivalent CD20-<br>binding molecule<br>component 216 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNSHHHASRVAREFP<br>KPSTPPGSSGGAPQVQLQQSGAELVRPGASVKMSC<br>TSGYTFTSYNMHWVKQTPRQGLEWIGAIYPGNGD<br>TSFNQKFKGKATLTADKSSSTVYMQLSSLTSEDSAV<br>YYCARSNYYGSSYVWFFDVWGAGTTVTVSSGGGG<br>SGGGGSGGGGSGGGGSGGGGSQIVLSQSPTILSASPG<br>EKVTMTCRASSSVSYMHWYQQKPGSSPKPWIYAPS<br>NLASGVPARFSGSGSGTSYSLTISRVEAEDAATYYC<br>QQWISFNPPTFGAGTKLELKDEL |
| SEQ ID NO: 263 | multivalent CD20-<br>binding molecule<br>component 217 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNSHHHASRVAREFP<br>KPSTPPGSSGGAPQVQLQQSGAELVRPGASVKMSC<br>KTSGYTFTSYNMHWVKQTPRQGLEWIGAIYPGNGD |

| ID Number | Text Description | Biological Sequence |
|---|---|---|
| | | TSFNQKFKGKATLTADKSSSTVYMQLSSLTSEDSAV<br>YYCARSNYYGSSYVWFFDVWGAGTTVTVSSGSTSG<br>SGKPGSGEGSQIVLSQSPTILSASPGEKVTMTCRASSS<br>VSYMHWYQQKPGSSPKPWIYAPSNLASGVPARFSG<br>SGSGTSYSLTISRVEAEDAATYYCQQWISFNPPTFGAG<br>TKLELKDEL |
| SEQ ID NO: 264 | multivalent CD20-<br>binding molecule<br>component 218 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNSHHASRVAREFP<br>KPSTPPGSSGGAPQVQLQQSGAELVRPGASVKMSC<br>KTSGYTFTSYNMHWVKQTPRQGLEWIGAIYPGNGD<br>TSFNQKFKGKATLTADKSSSTVYMQLSSLTSEDSAV<br>YYCARSNYYGSSYVWFFDVWGAGTTVTVSSGGGG<br>SQIVLSQSPTILSASPGEKVTMTCRASSSVSYMHWY<br>QQKPGSSPKPWIYAPSNLASGVPARFSGSGSGTSYSL<br>TISRVEAEDAATYYCQQWISFNPPTFGAGTKLELKDE<br>L |
| SEQ ID NO: 265 | multivalent CD20-<br>binding molecule<br>component 219 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNSHHASRVARGG<br>GGSGGQVQLQQPGAELVRPGASVKMSCTSGYTFT<br>SYNMHWVKQTPRQGLEWIGAIYPGNGDTSFNQKFK<br>GKATLTADKSSSTVYMQLSSLTSEDSAVYYCARSN<br>YYGSSYVWFFDVWGAGTTVTVSSGGGGSGGGGSG<br>GGGSGGGGSGGGGSQIVLSQSPTILSASPGEKVTMT<br>CRASSSVSYMHWYQQKPGSSPKPWIYAPSNLASGV<br>PARFSGSGSGTSYSLTISRVEAEDAATYYCQQWISFNP<br>PTFGAGTKLELKDEL |
| SEQ ID NO: 266 | multivalent CD20-<br>binding molecule<br>component 220 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNSHHASRVARGG<br>GGSGGQVQLQQSGAELVRPGASVKMSCKTSGYTFT<br>SYNMHWVKQTPRQGLEWIGAIYPGNGDTSFNQKFK<br>GKATLTADKSSSTVYMQLSSLTSEDSAVYYCARSN<br>YYGSSYVWFFDVWGAGTTVTVSSGSTSGSGKPGSG<br>EGSQIVLSQSPTILSASPGEKVTMTCRASSSVSYMHW<br>YQQKPGSSPKPWIYAPSNLASGVPARFSGSGSGTSY<br>SLTISRVEAEDAATYYCQQWISFNPPTFGAGTKLELK<br>DEL |
| SEQ ID NO: 267 | multivalent CD20-<br>binding molecule<br>component 221 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNSHHASRVARGG<br>GGSGGQVQLQQSGAELVRPGASVKMSCTSGYTFT<br>SYNMHWVKQTPRQGLEWIGAIYPGNGDTSFNQKFK<br>GKATLTADKSSSTVYMQLSSLTSEDSAVYYCARSN<br>YYGSSYVWFFDVWGAGTTVTVSSGGGGSQIVLSQS<br>PTILSASPGEKVTMTCRASSSVSYMHWYQQKPGSSP<br>KPWIYAPSNLASGVPARFSGSGSGTSYSLTISRVEAE<br>DAATYYCQQWISFNPPTFGAGTKLELKDEL |
| SEQ ID NO: 268 | multivalent CD20-<br>binding molecule<br>component 222 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSA<br>DSSYTTLQRVAGISRTGMQINRHSLTTSYLDLMSHS<br>ATSLTQSVARAMLRFVTVTAEALRFRQIQRGFRTTL<br>DDLSGASYVMTAEDVDLTLNWGRLSSVLPDYHGQ |

| ID Number | Text Description | Biological Sequence |
|---|---|---|
| | | DSVRVGRISFGSINAILGSVALILNSHHASEFPKPST PPGSSGGAPQVQLQQPGAELVRPGASVKMSCTSG YTFTSYNMHWVKQTPRQGLEWIGAIYPGNGDTSFN QKFKGKATLTADKSSSTVYMQLSSLTSEDSAVYYC ARSNYYGSSYVWFFDVWGAGTTVTVSSGGGGSGG GGSGGGGSGGGGSGGGGSQIVLSQSPTILSASPGEK VTMTCRASSSVSYMHWYQQKPGSSPKPWIYAPSNL ASGVPARFSGSGSGTSYSLTISRVEAEDAATYYCQQ WISNPPTFGAGTKLELKDEL |
| SEQ ID NO: 269 | multivalent CD20-binding molecule component 223 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHASRVAREFP KPSTPPGSSGGAPQVQLQQPGAELVRPGASVKMSC KTSGYTFTSYNMHWVKQTPRQGLEWIGAIYPGNGD TSFNQKFKGKATLTADKSSSTVYMQLSSLTSEDSAV YYCARSNYYGSSYVWFFDVWGAGTTVTVSSGGSTSG SGKPGSGEGSQIVLSQSPTILSASPGEKVTMTCRASSS VSYMHWYQQKPGSSPKPWIYAPSNLASGVPARFSG SGSGTSYSLTISRVEAEDAATYYCQQWISFNPPTFGAG TKLELKDEL |
| SEQ ID NO: 270 | multivalent CD20-binding molecule component 224 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVAREFP KPSTPPGSSGGAPQVQLVQSGAEVKKPGSSVKVSCK ASGYAFSYSWINWVRQAPGQGLEWMGRIFPGDGDT DYNGKFKGRVTITADKSTSTAYMELSSLRSEDTAVY YCARNVFDGYWLVYWGQGTLVTVSSGSTSGSGKP GSGWGSDIVMTQTPLSLPVTPGEPASISCRSSKSLLHS NGITYLYWYLQKPGQSPSLLIYQMSNLVSGVPDRFS GSGSGTDFTLKISRVEAEDVGVYYCAQNLELPYTFG GGTKVEIK |
| SEQ ID NO: 271 | multivalent CD20-binding molecule component 225 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVARGG GGSGGGQVQLVQSGAEVKKPGSSVKVSCKASGYAFS YSWINWVRQAPGQGLEWMGRIFPGDGDTDYNGKF KGRVTITADKSTSTAYMELSSLRSEDTAVYYCARNV FDGYWKVYWGQGTLVTVSSGGGGSDIVMTQTPLSL PVTPGEPASISCRSSKSLLHSNGITYLYWYLQKPGQS PQLLIYQMSNLVSGVPDRFSGSGSGTDFTLKISRVEA EDVGVYYCAQNLELPYTFGGGTKVEIKDEL |
| SEQ ID NO: 272 | multivalent CD20-binding molecule component 226 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVAREFP KPSTPPGSSGGAPQVQLVQSGAEVKKPGSSVKVSCK ASGYAFSYSWINWVRQAPGQGLEWMGRIFPGDGDT DYNGKFKGRVTITADKSTSTAYMELSSLRSEDTAVY YCARNVFDGYWLVYWGQGTLVTVSSGGGGSGGGG SGGGGSGGGGSGGGGSDIVMTQTPLSLPVTPGEPASI SCRSSKSLLHSNGITYLYWYLQKPGQSPQLLIYQMS NLVSGVPDRFSGSGSGTDFTLKISRVEAEDVGVYYC AQNLELPYTFGGGTKVEIK |

-continued

| ID Number | Text Description | Biological Sequence |
|---|---|---|
| SEQ ID NO: 273 | multivalent CD20-binding molecule component 227 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVAREFP KPSTPPGSSGGAPQVQLVQSGAEVKKPGSSVKVSCK ASGYAFSYSWINWVRQAPGQGLEWMGRIFPGDGDT DYNGKFKGRVTITADKSTSTAYMELSSLRSEDTAVY YCARNVVFDGYWLVYWGQGTLVTSSGGGGSDIVM TQTPLSLPVTPGEPASISCRSSKSLLHSNGITYLYWYL QKPGQSPQLLIYQMSNLVSGVPDRFSGSGSGTDFTL KISRVEAEDVGVYYCAQNLELPYTFGGGTKVEIK |
| SEQ ID NO: 274 | multivalent CD20-binding molecule component 228 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVAREFP KPSTPPGSSGGAPQVQLVQSGAEVKKPGSSVKVSCK ASGYAFSYSWINWVRQAPGQGLEWMGRIFPGDGDT DYNGKFKGRVTITADKSTSTAYMELSSLRSEDTAVY YCARNVVFDGYWLKVYWGQGTLVTVSSGSTSGGSGKP GSGEGSDIVMTQTPLSLPVTPGEPASISCRSSKSLLHS NGITYLYWYLQKPGQSPQLLIYQMSNLVSGVPDRFS GSGSGTDFTLKISRVEAEDVGVYYCAQNLELPYTFG GGTKVEIKDEL |
| SEQ ID NO: 275 | multivalent CD20-binding molecule component 229 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVAREFP KPSTPPGSSGGAPDIVMTQTPLSLPVTPGEPASISCR SKSLLHSNGITYLYWYLQKPGQSPQLLIYQMSNLVS GVPDRFSGSGSGTDFTLKISRVEAEDVGVYYCAQNL ELPYTFGGGTKVEIKGSTSGSGKPGSGEGSQVQLVQ SGAEVKKPGSSVKVSCKASGYAFSYSWINWVRQAP GQGLEWMGRIFPGDGDTDYNGKFKGRVTITADKST STAYMELSSLRSEDTAVYYCARNVFDGYWLKVYWG QGTLVTVSS |
| SEQ ID NO: 276 | multivalent CD20-binding molecule component 230 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVARGG GGSGGDIVMTQTPLSLPVTPGEPASISCRSKSLLHS NGITYLYWYLQKPGQSPQLLIYQMSNLVSGVPDRFS GSGSGTDFTLKISRVEAEDVGVYYCAQNLELPYTFG GGTKVEIKGGGGSGGGGSGGGGSGGGGSGGGGSQ VQLVQSGAEVKKPGSSVKVSCKASGYAFSYSWINW VRQAPGQGLEWMGRIFPGDGDTDYNGKFKGRVTIT ADKSTSTAYMELSSLRSEDTAVYYCARNVFDGYWLK VYWGQGTLVTVSS |
| SEQ ID NO: 277 | multivalent CD20-binding molecule component 231 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVARGG GGSGGDIVMTQTPLSLPVTPGEPASISCRSKSLLHS NGITYLYWYLQKPGQSPQLLIYQMSNLVSGVPDRFS GSGSGTDFTLKISRVEAEDVGVYYCAQNLELPYTFG GGTKVEIKGGGGSQVQLVQSGAEVKKPGSSVKVSC KASGYAFSYSWINWVRQAPGQGLEWMGRIFPGDG |

| | | Sequence Listing |
|---|---|---|
| ID Number | Text Description | Biological Sequence |
| | | DTDYNGKFKGRVTITADKSTSTAYMELSSLRSEDTA<br>VYYCARNVFDGYWLKVYWGQGTLVTVSS |
| SEQ ID NO: 278 | multivalent CD20-<br>binding molecule<br>component 232 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHHASEFPKPST<br>PPGSGGDIVMTQTPLSLPVTPGEPASISCRSKSL<br>LHSNGITYLYWYLQKPGQSPQLLIYQMSNLVSGVPD<br>RFSGSGSGTDFTLKISRVEAEDVGVYYCAQNLELPY<br>TFGGGTKVEIKGSTSGSGKPGSGEGSQVQLVQSGAE<br>VKKPGSSVKVSCKASGYAFSYSWINWVRQAPGQGL<br>EWMGRIFPGDGDTDYNGKFKGRVTITADKSTSTAY<br>MELSSLRSEDTAVYYCARNVFDGYWLKVYWGQGTL<br>VTVSS |
| SEQ ID NO: 279 | multivalent CD20-<br>binding molecule<br>component 233 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHHASRVAREFP<br>KPSTPGGSGGDIVMTQTPLSLPVTPGEPASISCR<br>SKSLLHSNGITYLYWYLQKPGQSPQLLIYQMSNLVS<br>GVPDRFSGSGSGTDFTLKISRVEAEDVGVYYCAQNL<br>ELPYTFGGGTKVEIKGSTSGSGKPGSGEGSQVQLVQ<br>SGAEVKKPGSSVKVSCKASGYAFSYSWINWVRQAP<br>GQGLEWMGRIFPGDGDTDYNGKFKGRVTITADKST<br>STAYMELSSLRSEDTAVYYCARNVFDGYWLKVYWG<br>QGTLVTVSS |
| SEQ ID NO: 280 | multivalent CD20-<br>binding molecule<br>component 234 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHHASEFPKPST<br>PPGSGGDIVMTQTPLSLPVTPGEPASISCRSKSL<br>LHSNGITYLYWYLQKPGQSPQLLIYQMSNLVSGVPD<br>RFSGSGSGTDFTLKISRVEAEDVGVYYCAQNLELPY<br>TFGGGTKVEIKGSTSGSGKPGSGEGSQVQLVQSGAE<br>VKKPGSSVKVSCKASGYAFSYSWINWVRQAPGQGL<br>EWMGRIFPGDGDTDYNGKFKGRVTITADKSTSTAY<br>MELSSLRSEDTAVYYCARNVFDGYWLKVYWGQGTL<br>VTVSS |
| SEQ ID NO: 281 | multivalent CD20-<br>binding molecule<br>component 235 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHHASRVAREFP<br>KPSTPPGSSGAPQIVLSQSPAILSASPGEKVTMTCR<br>ASSSVSYMHWYQQKPGSSPKPWIYAPSNLASGVPA<br>RFSGSGSGTSYSLTISRVEAEDAATYYCQQWSFNPPT<br>FGAGTKLELKSGSTSGSGKPGSGEGSQAYLQQSGAE<br>LVRPGASVKMSCKTSGYTFTSYNMHWVKQTPRQG<br>LEWIGAIYPGNGDTSFNQKFKGKATLTVDKSSSTAY<br>MQLSSLTSEDSAVYFCARVVYYSNSYWFDVWGT<br>GTTVTVS |
| SEQ ID NO: 282 | multivalent CD20-<br>binding molecule<br>component 236 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHHASRVAREFP<br>KPSTPPGSSGAPQIVLSQSPAILSASPGEKVTMTCR<br>ASSSVSYMHWYQQKPGSSPKPWIYAPSNLASGVPA<br>RFSGSGSGTSYSLTISRVEAEDAATYYCQQWSFNPPT |

| ID Number | Text Description | Biological Sequence |
|---|---|---|
| | | FGAGTKLELKSGSTSGGGGSQAYLQQSGAELVRPGASVK<br>MSCKTSGYTFTSYNMHWVKQTPRQGLEWIGAIYPG<br>NGDTSFNQKFKGKATLTVDKSSSTAYMQLSSLTSE<br>DSAVYFCARVVYYSNSYWFDVWGTGTTVTVS |
| SEQ ID NO: 283 | multivalent CD20-<br>binding molecule<br>component 237 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHHASRVAREFP<br>KPSTPPGSSGAPQIVLSQSPAILSASPGEKVTMTCR<br>ASSSVSYMHWYQQKPGSSPKPWIYAPSNLASGVPA<br>RFSGSGSGTSYSLTISRVEAEDAATYYCQQWSFNPPT<br>FGAGTKLELKSGSTSGGKPGSGEGSQAYLQQSGAE<br>LVRPGASVKMSCKTSGYTFTSYNMHWVKQTPRQG<br>LEWIGAIYPGNGDTSFNQKFKGKATLTVDKSSSTAY<br>MQLSSLTSEDSAVYFCARVVYYSNSYWFDVWGT<br>GTTVTVS |
| SEQ ID NO: 284 | multivalent CD20-<br>binding molecule<br>component 238 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHHASRVAREFP<br>KPSTPPGSSGAPQIVLSQSPAILSASPGEKVTMTCR<br>ASSSVSYMHWYQQKPGSSPKPWIYAPSNLASGVPA<br>RFSGSGSGTSYSLTISRVEAEDAATYYCQQWSFNPPT<br>FGAGTKLELKSGSTSGGKPGSGEGSQAYLQQSGAE<br>LVRPGASVKMSCKTSGYTFTSYNMHWVKQTPRQG<br>LEWIGAIYPGNGDTSFNQKFKGKATLTVDKSSSTAY<br>MQLSSLTSEDSAVYFCARVVYYSNSYWFDVWGT<br>GTTVTVS |
| SEQ ID NO: 285 | multivalent CD20-<br>binding molecule<br>component 239 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHHASRVARGG<br>GGSGGQIVLSQSPAILSASPGEKVTMTCRASSSVSYM<br>HWYQQKPGSSPKPWIYAPSNLASGVPARFSGSGSGT<br>SYSLTISRVEAEDAATYYCQQWSFNPPTFGAGTKLE<br>LKSGGGGSGGGGSGGGGSGGGGSQAYLQQ<br>SGAELVRPGASVKMSCKTSGYTFTSYNMHWVKQT<br>PRQGLEWIGAIYPGNGDTSFNQKFKGKATLTVDKSS<br>STAYMQLSSLTSEDSAVYFCARVVYYSNSYWFDV<br>WGTGTTVTVS |
| SEQ ID NO: 286 | multivalent CD20-<br>binding molecule<br>component 240 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHHASRVAAEF<br>PKPSTPPGSSGAPQIVLSQSPAILSASPGEKVTMTCR<br>ASSSVSYMHWYQQKPGSSPKPWIYAPSNLASGVPA<br>RFSGSGSGTSYSLTISRVEAEDAATYYCQQWSFNPPT<br>FGAGTKLELKSGSTSGGKPGSGEGSQAYLQQSGAE<br>LVRPGASVKMSCKTSGYTFTSYNMHWVKQTPRQG<br>LEWIGAIYPGNGDTSFNQKFKGKATLTVDKSSSTAY<br>MQLSSLTSEDSAVYFCARVVYYSNSYWFDVWGT<br>GTTVTVS |
| SEQ ID NO: 287 | multivalent CD20-<br>binding molecule<br>component 241 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ |

| Sequence Listing | | |
|---|---|---|
| ID Number | Text Description | Biological Sequence |
| | | DSVRVGRISFGSINAILGSVALILNSHHASRVAREFP<br>KPSTPPGSSGGAPEIVLSQSPATLSLSPGERATLSCRA<br>SQSVSSYLAWYQQKPGQAPKPLLIYDASNRATGIPAR<br>FSGSGSGTSYSLTISSLEPEDFAVYYCQQRSNWPITF<br>GQGTRLEIKSGSTSGSGKPGSGEGSEVQLVESGGGLV<br>QPGRSLRLSCAASGFTFNDYAMHWVRQAPGKGLE<br>WVSTISWNSGSIGYADSVKGRFTISRDNAKKSLYLQ<br>MNSLRAEDTALYYCAKDIQYGNYYYGMDVWGQG<br>TTVTVSSKDEL |
| SEQ ID NO: 288 | multivalent CD20-<br>binding molecule<br>component 242 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHASRVARGG<br>GGSGGEIVLTQSPATLSLSPGERATLSCRASQSVSSY<br>LAWYQQKPGQAPKPLLIYDASNRATGIPARFSGSGSG<br>TDFTLTISSLEPEDFAVYYCQQRSNWPITFGQGTRLEI<br>KGGGGSGGGGSGGGGSGGGGSGGGGSEVQLVESG<br>GGLVQPGRSLRLSCAASGFTFNDYAMHWVRQAPG<br>KGLEWVSTISWNSGSIGYADSVKGRFTISRDNAKKS<br>LYLQMNSLRAEDTALYYCAKDIQYGNYYYGMDVW<br>GQGTTVTVSS |
| SEQ ID NO: 289 | multivalent CD20-<br>binding molecule<br>component 243 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHASRVARGG<br>GGSGGEIVLTQSPATLSLSPGERATLSCRASQSVSSY<br>LAWYQQKPGQAPKPLLIYDASNRATGIPARFSGSGSG<br>TDFTLTISSLEPEDFAVYYCQQRSNWPITFGQGTRLEI<br>KGGGGSGGGGSGGGGSGGGGSGGGGSEVQLVESG<br>GGLVQPGRSLRLSCAASGFTFNDYAMHWVRQAPG<br>KGLEWVSTISWNSGSIGYADSVKGRFTISRDNAKKS<br>LYLQMNSLRAEDTALYYCAKDIQYGNYYYGMDVW<br>GQGTTVTVSS |
| SEQ ID NO: 290 | multivalent CD20-<br>binding molecule<br>component 244 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHASGGGSG<br>GEIVLTQSPATLSLSPGERATLSCRASQSVSSYLAWY<br>QQKPGQAPKPLLIYDASNRATGIPARFSGSGSGTDFTL<br>TISSLEPEDFAVYYCQQRSNWPITFGQGTRLEIKGST<br>SGSGKPGSGEGSEVQLVESGGGLVQPGRSLRLSCAA<br>SGFTFNDYAMHWVRQAPGKGLEWVSTISWNSGSIG<br>YADSVKGRFTISRDNAKKSLYLQMNSLRAEDTALY<br>YCAKDIQYGNYYYGMDVWGQGTTVTVSS |
| SEQ ID NO: 291 | multivalent CD20-<br>binding molecule<br>component 245 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGASYVMTAEDVDLTLNWGRLSSVLPDYHGQ<br>DSVRVGRISFGSINAILGSVALILNSHHASVARGG<br>GGSGGEIVLTQSPATLSLSPGERATLSCRASQSVSSY<br>LAWYQQKPGQAPKPLLIYDASNRATGIPARFSGSGSG<br>TDFTLTISSLEPEDFAVYYCQQRSNWPITFGQGTRLEI<br>KGGGGSEVQLVESGGGLVQPGRSLRLSCAASGFTFN<br>DYAMHWVRQAPGKGLEWVSTISWNSGSIGYADSV<br>KGRFTISRDNAKKSLYLQMNSLRAEDTALYYCAKDI<br>QYGNYYYGMDVWGQGTTVTVSS |
| SEQ ID NO: 292 | multivalent CD20-<br>binding molecule<br>component 246 | KEFTLDFSTAKTYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLSG |

| Sequence Listing | | |
|---|---|---|
| ID Number | Text Description | Biological Sequence |
| | | DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASEFPKPST PPGSSGGAPEIVLTQSPATLSLSPGERATLSCRASQSV SSYLAWYQQKPGQAPKPLLIYDASNRATGIPARFSGS GSGTDFTLTISSLEPEDFAVYYCQQRSNWPITFGQGT RLEIKGSTSGSGKPGSGEGSEVQLVESGGGLVQPGR SLRLSCAASGFTFNDYAMHWVRQAPGKGLEWVSTI SWNSGSIGYADSVKGRFTISRDNAKKSLYLQMNSLR AEDTALYYCAKDIQYGNYYYGMDVWGQGTTVTVSS |
| SEQ ID NO: 293 | multivalent CD20-binding molecule component 247 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASRVAREFP KPSTPPGSSGGAPQVQLVQSGAELVKPGASVKMSC KASGYTFTSYNMHWVKQTPGRGLEWIGAIYPGNGD TSYNQKFKGKATLTADKSSSTAYMQLSSLTSEDSAV YYCARSTYYGGDWYFNVWGAGTTVTVSAGSTSGS GKPGSGEGSTKGQIVLSQSPAILSASPGEKVTMTCRA SSSVSYIHWFQQKPGSSPKPWTYATSMLASGVPVRFS GSGSGTSYSLTISRVEAEDAATYYCQQWTSNPPTFG GGTRLEIK |
| SEQ ID NO: 294 | multivalent CD20-binding molecule component 248 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASRVARGG GGSGGQVQLQQPGAELVKPGASVKMSCKASGYTFT SYNMHWVKQTPGRGLEWIGAIYPGNGDTSYNQKFK GKATLTADKSSSTAYMQLSSLTSEDSAVYYCARSTY YGGDWYFNVWGAGTTVTVSAGSTSGSGKPGSGEG STKGQIVLSQSPAILSASPGEKVTMTCRASSSVSYIH WFQQKPGSSPKPWTYATSMLASGVPVRFSGSGSGTS YSLTISRVEAEDAATYYCQQWTSNPPTFGGGTRLEI K |
| SEQ ID NO: 295 | multivalent CD20-binding molecule component 249 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASRVARGG GGSGGQVQLQQPGAELVKPGASVKMSCKASGYTFT SYNMHWVKQTPGRGLEWIGAIYPGNGDTSYNQKFK GKATLTADKSSSTAYMQLSSLTSEDSAVYYCARSTY YGGDWYFNVWGAGTTVTVSAGSTSGSGKPGSGEG STKGQIVLSQSPAILSASPGEKVTMTCRASSSVSYIH WFQQKPGSSPKPWTYATSMLASGVPVRFSGSGSGTS YSLTISRVEAEDAATYYCQQWTSNPPTFGGGTRLEI K |
| SEQ ID NO: 296 | multivalent CD20-binding molecule component 250 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASRVARGG GGSGGQVQLQQPGAELVKPGASVKMSCKASGYTFT SYNMHWVKQTPGRGLEWIGAIYPGNGDTSYNQKFK GKATLTADKSSSTAYMQLSSLTSEDSAVYYCARSTY YGGDWYFNVWGAGTTVTVSAGGGGSTKGQIVLSQ SPAILSASPGEKVTMTCRASSSVSYIHWFQQKPGSSP KPWIYATSNLASGVPVRFSGSGSGTSYSLTISRVEAE DAATYYCQQWTSNPPTFGGGTRLEIK |

| Sequence Listing | | |
|---|---|---|
| ID Number | Text Description | Biological Sequence |
| SEQ ID NO: 297 | multivalent CD20-binding molecule component 251 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVAREFP KPSTPPGSSGGAPQVQLQQPGAELVKPGASVKMSC KASGYTFTSYNMHWVKQTPGRGLEWIGAIYPGNGD TSYNQKFKGKATLTADKSSSTAYMQLSSLTSEDSAV YYCARSTYYGGDWYFNVWGAGTTVTVSAGGGGSG GGGSGGGGSGGGGSGGGGSTKGQIVLSQSPAILSAS PGEKVTMTCRASSSVSYIHWFQQKPGSSPKPWIYAT SNLASGVPVRFSGSGSGTSYSLTISRVEAEDAATYYC QQWTSNPPTFGGGTRLEIKDEL |
| SEQ ID NO: 298 | multivalent CD20-binding molecule component 252 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASAVAAGG GGSGGQVQLQQPGAELVKPGASVKMSCKASGYTFT SYNMHWVKQTPGRGLEWIGAIYPGNGDTSYNQKFK GKATLTADKSSSTAYMQLSSLTSEDSAVYYCARSTY YGGDWYFNVWGAGTTVTVSAGGGGSTKGQIVLSQ SPAILSASPGEKVTMTCRASSSVSYIHWFQQKPGSSP KPWIYATSMLASGVPVRFSGSGSGTSYSLTISRVEAE DAATYYCQQWTSNPPTFGGGTRLEIK |
| SEQ ID NO: 299 | multivalent CD20-binding molecule component 253 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVAREFP KPSTPPGSSGGAPQVQLQQPGAELVKPGASVKMSC KASGYTFTSYNMHWVKQTPGRGLEWIGAIYPGNGD TSYNQKFKGKATLTADKSSSTAYMQLSSLTSEDSAV YYCARSTYYGGDWYFNVWGAGTTVTVSSGSTSGS GKPGSGEGSDIVLSQSPAILSASPGEKVTMTCRASSS VSYMHWFQQKPGSSPKPWIYATSMLASGVPARFSG SGSGTSYSLTISRVEAEDAATYYCQQWTSNPPTFGAG TKLELK |
| SEQ ID NO: 300 | multivalent CD20-binding molecule component 254 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASRVAREFP KPSTPPGSSGGAPQVQLQQPGAELVKPGASVKMSC KASGYTFTSYNMHWVKQTPGRGLEWIGAIYPGNGD TSYNQKFKGKATLTADKSSSTAYMQLSSLTSEDSAV YYCARAQLRPNYWYFDVWGAGTTVTVSSGGGGSD IVLSQSPAILSASPGEKVTMTCRASSSVSYMHWFQQ KPGSSPKPWIYATSNLASGVPARFSGSGSGTSYSLTIS RVEAEDAATYYCQQWTSNPPTFGAGTKLELK |
| SEQ ID NO: 301 | multivalent CD20-binding molecule component 255 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHASGGGGSG GQVQLVQSGAELVKPGASVKMSCKASGYTFTSYN MHWVKQTPGRGLEWIGAIYPGNGDTSYNQKFKGK ATLTADKSSSTAYMQLSSLTSEDSAVYYCARAQLRP NYWYFDVWGAGTTVTVSSGSTSGSGKPGSGEGSDI VLSQSPAILSASPGEKVTMTCRASSSVSYMHWFQQ |

Sequence Listing

| ID Number | Text Description | Biological Sequence |
|---|---|---|
| | | KPGSSPKPWIYATSNLASGVPARFSGSGSGTSYSLTIS RVEAEDAATYYCQQWTSNPPTFGAGTKLELK |
| SEQ ID NO: 302 | multivalent CD20-binding molecule component 256 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAREFP KPSTPPGSSGGAPQVQLQQPGAELVKPGASVKMSC KASGYTFTSYNMHWVKQTPGRGLEWIGAIYPGNGD TSYNQKFKGKATLTADKSSSTAYMQLSSLTSEDSAV YYCARSTYYGGDWYFNVWGAGTTVTVSAGSTSGS GKPGSGEGSTKGQIVLSQSPAILSASPGEKVTMTCRA SSSVSYIHWFQQKPGSSPKPWIYATSMLASGVPVRFS GSGSGTSYSLTISRVEAEDAATYYCQQWTSNPPTFG GGTKLEIK |
| SEQ ID NO: 303 | multivalent CD20-binding molecule component 257 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAREFP KPSTPPGSSGGAPQVQLQQPGAELVKPGASVKMSC KASGYTFTSYNMHWVKQTPGRGLEWIGAIYPGNGD TSYNQKFKGKATLTADKSSSTAYMQLSSLTSEDSAV YYCARSTYYGGDWYFNVWGAGTTVTVSAGGGGST KGQIVLSQSPAILSASPGEKVTMTCRASSSVSYIHWF QQKPGSSPKPWIYATSMLASGVPVRFSGSGSGTSYSL TISRVEAEDAATYYCQQWTSNPPTFGGGTKLEIK |
| SEQ ID NO: 304 | multivalent CD20-binding molecule component 258 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAGG GGSGGQVQLQQPGAELVKPGASVKMSCKASGYTFT SYNMHWVKQTPGRGLEWIGAIYPGNGDTSYNQKFK GKATLTADKSSSTAYMQLSSLTSEDSAVYYCARSTY YGGDWYFNVWGAGTTVTVSAGGGGSGGGGSGGG GSGGGGSGGGSTKGQIVLSQSPAILSASPGEKVTM TCRASSSVSYIHWFQQKPGSSPKPWIYATSMLASGVP VRFSGSGSGTSYSLTISRVEAEDKDEL |

SEQUENCE LISTING (374 sequences)

SEQ ID NO: 1 - protein, 293 aa, Escherichia coli
  Shiga-like toxin 1 Subunit A (SLT-1A)
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 2 - protein, 293 aa, Shigella dysenteriae
  Shiga toxin Subunit A (StxA)
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 3 - protein, 297 aa, Escherichia coli
  Shiga-like toxin 2 Subunit A (SLT-2A)
DEFTVDFSSQKSYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQKQKTECQIVGDRAAIKVNNVLWEANTIAALLNRKPQDLTEPNQ

SEQ ID NO: 4 - protein, 251 aa, Escherichia coli
  Shiga toxin effector region SLT-1A
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 5 - protein, 10 aa, Artificial Sequence
  Description of Artificial Sequence: Synthetic peptide
  Heavy chain CDR1
GYTFTSYNMH

SEQ ID NO: 6 - protein, 17 aa, Artificial Sequence
  Description of Artificial Sequence: Synthetic peptide
  Heavy chain CDR2
AIYPGNGDTSYNQKFKG

SEQ ID NO: 7 - protein, 12 aa, Artificial Sequence
  Description of Artificial Sequence: Synthetic peptide
  Heavy chain CDR3
AQLRPNYWYFDV

SEQ ID NO: 8 - protein, 10 aa, Artificial Sequence
  Description of Artificial Sequence: Synthetic peptide
  Light chain CDR1
RASSSVSYMH

SEQ ID NO: 9 - protein, 7 aa, Artificial Sequence
  Description of Artificial Sequence: Synthetic peptide
  Light chain CDR2
ATSNLAS

SEQ ID NO: 10 - protein, 9 aa, Artificial Sequence
  Description of Artificial Sequence: Synthetic peptide
  Light chain CDR3
QQWISNPPT

SEQ ID NO: 11 - protein, 10 aa, Artificial Sequence
  Description of Artificial Sequence: Synthetic peptide
  Heavy chain CDR1
GYTFTSYNVH

SEQ ID NO: 12 - protein, 17 aa, Artificial Sequence
  Description of Artificial Sequence: Synthetic peptide
  Heavy chain CDR2
AIYPGNGDTSFNQKFKG

SEQ ID NO: 13 - protein, 14 aa, Artificial Sequence
  Description of Artificial Sequence: Synthetic peptide
  Heavy chain CDR3
SNYYGSSYVWFFDV

SEQ ID NO: 14 - protein, 10 aa, Artificial Sequence
  Description of Artificial Sequence: Synthetic peptide
  Light chain CDR1
RASSSVSYMD

SEQ ID NO: 15 - protein, 7 aa, Artificial Sequence
  Description of Artificial Sequence: Synthetic peptide
  Light chain CDR2
ATSNLAS

SEQ ID NO: 16 - protein, 9 aa, Artificial Sequence
  Description of Artificial Sequence: Synthetic peptide
  Light chain CDR3
QQWISNPPT

SEQ ID NO: 17 - protein, 10 aa, Artificial Sequence
  Description of Artificial Sequence: Synthetic peptide
  Heavy chain CDR1
GYTFTSYNMH

SEQ ID NO: 18 - protein, 17 aa, Artificial Sequence
  Description of Artificial Sequence: Synthetic peptide
  Heavy chain CDR2
AIYPGNGDTSYNQKFKG

SEQ ID NO: 19 - protein, 12 aa, Artificial Sequence
  Description of Artificial Sequence: Synthetic peptide
  Heavy chain CDR3
STYYGGDWYFNV

SEQ ID NO: 20 - protein, 10 aa, Artificial Sequence
  Description of Artificial Sequence: Synthetic peptide
  Light chain CDR1
RASSSVSYIH

SEQ ID NO: 21 - protein, 7 aa, Artificial Sequence
  Description of Artificial Sequence: Synthetic peptide
  Light chain CDR2
ATSNLAS

SEQ ID NO: 22 - protein, 9 aa, Artificial Sequence
  Description of Artificial Sequence: Synthetic peptide
  Light chain CDR3
QQWTSNPPT

SEQ ID NO: 23 - protein, 10 aa, Artificial Sequence
  Description of Artificial Sequence: Synthetic peptide
  Heavy chain CDR1
GFTFNDYAMH

SEQ ID NO: 24 - protein, 17 aa, Artificial Sequence
  Description of Artificial Sequence: Synthetic peptide
  Heavy chain CDR2
TISWNSGSIGYADSVKG

SEQ ID NO: 25 - protein, 13 aa, Artificial Sequence
  Description of Artificial Sequence: Synthetic peptide
  Heavy chain CDR3
DIQYGNYYYGMDV

SEQ ID NO: 26 - protein, 11 aa, Artificial Sequence
  Description of Artificial Sequence: Synthetic peptide
  Light chain CDR1
RASQSVSSYLA

SEQ ID NO: 27 - protein, 7 aa, Artificial Sequence
  Description of Artificial Sequence: Synthetic peptide
  Light chain CDR2
DASNRAT

SEQ ID NO: 28 - protein, 9 aa, Artificial Sequence
  Description of Artificial Sequence: Synthetic peptide
  Light chain CDR3
QQRSNWPIT

SEQ ID NO: 29 - protein, 10 aa, Artificial Sequence
  Description of Artificial Sequence: Synthetic peptide
  Heavy chain CDR1
GYTFTSYNMH

SEQ ID NO: 30 - protein, 17 aa, Artificial Sequence
  Description of Artificial Sequence: Synthetic peptide
  Heavy chain CDR2
AIYPGNGDTSYNQKFKG

SEQ ID NO: 31 - protein, 13 aa, Artificial Sequence
  Description of Artificial Sequence: Synthetic peptide
  Heavy chain CDR3
VVYYSNSYWYFDV

SEQ ID NO: 32 - protein, 10 aa, Artificial Sequence
  Description of Artificial Sequence: Synthetic peptide
  Light chain CDR1
RASSSVSYMH

SEQ ID NO: 33 - protein, 7 aa, Artificial Sequence
  Description of Artificial Sequence: Synthetic peptide
  Light chain CDR2
APSNLAS

SEQ ID NO: 34 - protein, 9 aa, Artificial Sequence
  Description of Artificial Sequence: Synthetic peptide
  Light chain CDR3
QQWSFNPPT

SEQ ID NO: 35 - protein, 10 aa, Artificial Sequence
  Description of Artificial Sequence: Synthetic peptide
  Heavy chain CDR1
GYAFSYSWIN

SEQ ID NO: 36 - protein, 17 aa, Artificial Sequence
  Description of Artificial Sequence: Synthetic peptide
  Heavy chain CDR2
RIFPGDGDTDYNGKFKG

SEQ ID NO: 37 - protein, 10 aa, Artificial Sequence
  Description of Artificial Sequence: Synthetic peptide
  Heavy chain CDR3
NVFDGYWLVY

SEQ ID NO: 38 - protein, 16 aa, Artificial Sequence
  Description of Artificial Sequence: Synthetic peptide
  Light chain CDR1
RSSKSLLHSNGITYLY

SEQ ID NO: 39 - protein, 7 aa, Artificial Sequence
  Description of Artificial Sequence: Synthetic peptide
  Light chain CDR2
QMSNLVS

SEQ ID NO: 40 - protein, 9 aa, Artificial Sequence
  Description of Artificial Sequence: Synthetic peptide
  Light chain CDR3
AQNLELPYT

SEQ ID NO: 41 - protein, 16 aa, Artificial Sequence
  Description of Artificial Sequence: Synthetic peptide
  Linker 1
EFPKPSTPPGSSGGAP

SEQ ID NO: 42 - protein, 7 aa, Artificial Sequence
  Description of Artificial Sequence: Synthetic peptide
  Linker 2
GGGGSGG

SEQ ID NO: 43 - protein, 25 aa, Artificial Sequence
  Description of Artificial Sequence: Synthetic peptide
  Linker 3
GGGGSGGGGSGGGGSGGGGSGGGGS

SEQ ID NO: 44 - protein, 15 aa, Artificial Sequence
  Description of Artificial Sequence: Synthetic peptide
  Linker 4
GSTSGSGKPGSGEGS

SEQ ID NO: 45 - protein, 5 aa, Artificial Sequence
  Description of Artificial Sequence: Synthetic peptide
  Linker 5
GGGGS

SEQ ID NO: 46 - protein, 9 aa, Artificial Sequence
  Description of Artificial Sequence: Synthetic peptide
  Linker extension
GILGFVFTL

SEQ ID NO: 47 - protein, 523 aa, Artificial Sequence
  Description of Artificial Sequence: Synthetic polypeptide
  Multivalent CD20-binding molecule component 1
  MISC_FEATURE (510)..(510): Cys residue at this position is available to form a homodimer or heterodimer via a disulfide bond with any of SEQ ID NOS 47-175
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSGGGGSGGGGSGGGGSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 48 - protein, 509 aa, Artificial Sequence
  Description of Artificial Sequence: Synthetic polypeptide
  Multivalent CD20-binding molecule component 2
  MISC_FEATURE (500)..(500): Cys residue at this position is available to form a homodimer or heterodimer via a disulfide bond with any of SEQ ID NOS 47-175
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 49 - protein, 499 aa, Artificial Sequence
  Description of Artificial Sequence: Synthetic polypeptide
  Multivalent CD20-binding molecule component 3
  MISC_FEATURE (490)..(490): Cys residue at this position is available to form a homodimer or heterodimer via a disulfide bond with any of SEQ ID NOS 47-175
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGTGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 50 - protein, 510 aa, Artificial Sequence
  Description of Artificial Sequence: Synthetic polypeptide
  Multivalent CD20-binding molecule component 4
  MISC_FEATURE (501)..(501): Cys residue at this position is available to form a homodimer or heterodimer via a disulfide bond with any of SEQ ID NOS 47-175
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSGGGGSGGGGSGGGGSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 51 - protein, 500 aa, Artificial Sequence
  Description of Artificial Sequence: Synthetic polypeptide
  Multivalent CD20-binding molecule component 5
  MISC_FEATURE (491)..(491): Cys residue at this position is available to form a homodimer or heterodimer via a disulfide bond with any of SEQ ID NOS 47-175
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 52 - protein, 508 aa, Artificial Sequence
  Description of Artificial Sequence: Synthetic polypeptide
  Multivalent CD20-binding molecule component 6
  MISC_FEATURE (499)..(499): Cys residue at this position is available to form a homodimer or heterodimer via a disulfide bond with any of SEQ ID NOS 47-175
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 53 - protein, 521 aa, Artificial Sequence
  Description of Artificial Sequence: Synthetic polypeptide
  Multivalent CD20-binding molecule component 7
  MISC_FEATURE (512)..(512): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 54 - protein, 512 aa, Artificial Sequence
  Description of Artificial Sequence: Synthetic polypeptide
  Multivalent CD20-binding molecule component 8
  MISC_FEATURE (503)..(503): Cys residue at this position is available to form a homodimer or heterodimer via a disulfide bond with any of SEQ ID NOS 47-175
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 55 - protein, 511 aa, Artificial Sequence
  Description of Artificial Sequence: Synthetic polypeptide
  Multivalent CD20-binding molecule component 9
  MISC_FEATURE (502)..(502): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 56 - protein, 501 aa, Artificial Sequence
  Description of Artificial Sequence: Synthetic polypeptide
  Multivalent CD20-binding molecule component 10
  MISC_FEATURE (492)..(492): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 57 - protein, 512 aa, Artificial Sequence
  Description of Artificial Sequence: Synthetic polypeptide
  Multivalent CD20-binding molecule component 11
  MISC_FEATURE (503)..(503): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 58 - protein, 502 aa, Artificial Sequence
  Description of Artificial Sequence: Synthetic polypeptide
  Multivalent CD20-binding molecule component 12
  MISC_FEATURE (493)..(493): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 59 - protein, 530 aa, Artificial Sequence
  Description of Artificial Sequence: Synthetic polypeptide
  Multivalent CD20-binding molecule component 13
  MISC_FEATURE (521)..(521): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 60 - protein, 520 aa, Artificial Sequence
  Description of Artificial Sequence: Synthetic polypeptide
  Multivalent CD20-binding molecule component 14
  MISC_FEATURE (511)..(511): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 61 - protein, 510 aa, Artificial Sequence
  Description of Artificial Sequence: Synthetic polypeptide
  Multivalent CD20-binding molecule component 15
  MISC_FEATURE (501)..(501): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 62 - protein, 492 aa, Artificial Sequence
  Description of Artificial Sequence: Synthetic polypeptide
  Multivalent CD20-binding molecule component 16
  MISC_FEATURE (483)..(483): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 63 - protein, 517 aa, Artificial Sequence
  Description of Artificial Sequence: Synthetic polypeptide
  Multivalent CD20-binding molecule component 17
  MISC_FEATURE (512)..(512): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHAS

SEQ ID NO: 64 - protein, 511 aa, Artificial Sequence
  Description of Artificial Sequence: Synthetic polypeptide
  Multivalent CD20-binding molecule component 18
  MISC_FEATURE (502)..(502): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 65 - protein, 526 aa, Artificial Sequence
  Description of Artificial Sequence: Synthetic polypeptide
  Multivalent CD20-binding molecule component 19
  MISC_FEATURE (521)..(521): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHAS

SEQ ID NO: 66 - protein, 525 aa, Artificial Sequence
  Description of Artificial Sequence: Synthetic polypeptide
  Multivalent CD20-binding molecule component 20
  MISC_FEATURE (512)..(512): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 67 - protein, 515 aa, Artificial Sequence
  Description of Artificial Sequence: Synthetic polypeptide
  Multivalent CD20-binding molecule component 21
  MISC_FEATURE (502)..(502): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 68 - protein, 505 aa, Artificial Sequence
  Description of Artificial Sequence: Synthetic polypeptide
  Multivalent CD20-binding molecule component 22
  MISC_FEATURE (492)..(492): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 69 - protein, 516 aa, Artificial Sequence
  Description of Artificial Sequence: Synthetic polypeptide
  Multivalent CD20-binding molecule component 23
  MISC_FEATURE (503)..(503): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 70 - protein, 506 aa, Artificial Sequence
  Description of Artificial Sequence: Synthetic polypeptide
  Multivalent CD20-binding molecule component 24
  MISC_FEATURE (493)..(493): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 71 - protein, 534 aa, Artificial Sequence
  Description of Artificial Sequence: Synthetic polypeptide
  Multivalent CD20-binding molecule component 25
  MISC_FEATURE (521)..(521): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 72 - protein, 524 aa, Artificial Sequence
  Description of Artificial Sequence: Synthetic polypeptide
  Multivalent CD20-binding molecule component 26
  MISC_FEATURE (511)..(511): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 73 - protein, 514 aa, Artificial Sequence
  Description of Artificial Sequence: Synthetic polypeptide
  Multivalent CD20-binding molecule component 27
  MISC_FEATURE (501)..(501): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 74 - protein, 496 aa, Artificial Sequence
  Description of Artificial Sequence: Synthetic polypeptide
  Multivalent CD20-binding molecule component 28
  MISC_FEATURE (483)..(483): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 75 - protein, 521 aa, Artificial Sequence
  Description of Artificial Sequence: Synthetic polypeptide
  Multivalent CD20-binding molecule component 29
  MISC_FEATURE (512)..(512): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASKDEL

SEQ ID NO: 76 - protein, 515 aa, Artificial Sequence
  Description of Artificial Sequence: Synthetic polypeptide
  Multivalent CD20-binding molecule component 30
  MISC_FEATURE (502)..(502): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 77 - protein, 530 aa, Artificial Sequence
  Description of Artificial Sequence: Synthetic polypeptide
  Multivalent CD20-binding molecule component 31
  MISC_FEATURE (521)..(521): Cys residue at this position is available to form a homodimer or heterodimer via a disulfide bond with any of SEQ ID NOS 47-175
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASKDEL

SEQ ID NO: 78 - protein, 512 aa, Artificial Sequence
  Description of Artificial Sequence: Synthetic polypeptide
  Multivalent CD20-binding molecule component 32
  MISC_FEATURE (503)..(503): Cys residue at this position is available to form a homodimer or heterodimer via a disulfide bond with any of SEQ ID NOS 47-175
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 79 - protein, 497 aa, Artificial Sequence
  Description of Artificial Sequence: Synthetic polypeptide
  Multivalent CD20-binding molecule component 33
  MISC_FEATURE (484)..(484): Cys residue at this position is available to form a homodimer or heterodimer via a disulfide bond with any of SEQ ID NOS 47-175
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 80 - protein, 522 aa, Artificial Sequence
  Description of Artificial Sequence: Synthetic polypeptide
  Multivalent CD20-binding molecule component 34
  MISC_FEATURE (513)..(513): Cys residue at this position is available to form a homodimer or heterodimer via a disulfide bond with any of SEQ ID NOS 47-175
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSGGGGSGGGGSGGGGSGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 81 - protein, 502 aa, Artificial Sequence
  Description of Artificial Sequence: Synthetic polypeptide
  Multivalent CD20-binding molecule component 35
  MISC_FEATURE (493)..(493): Cys residue at this position is available to form a homodimer or heterodimer via a disulfide bond with any of SEQ ID NOS 47-175
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 82 - protein, 512 aa, Artificial Sequence
  Description of Artificial Sequence: Synthetic polypeptide
  Multivalent CD20-binding molecule component 36
  MISC_FEATURE (503)..(503): Cys residue at this position is available to form a homodimer or heterodimer via a disulfide bond with any of SEQ ID NOS 47-175
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 83 - protein, 521 aa, Artificial Sequence
  Description of Artificial Sequence: Synthetic polypeptide
  Multivalent CD20-binding molecule component 37
  MISC_FEATURE (512)..(512): Cys residue at this position is available to form a homodimer or heterodimer via a disulfide bond with any of SEQ ID NOS 47-175
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 84 - protein, 516 aa, Artificial Sequence
  Description of Artificial Sequence: Synthetic polypeptide
  Multivalent CD20-binding molecule component 38
  MISC_FEATURE (503)..(503): Cys residue at this position is available to form a homodimer or heterodimer via a disulfide bond with any of SEQ ID NOS 47-175
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 85 - protein, 513 aa, Artificial Sequence
  Description of Artificial Sequence: Synthetic polypeptide
  Multivalent CD20-binding molecule component 39
  MISC_FEATURE (504)..(504): Cys residue at this position is available to form a homodimer or heterodimer via a disulfide bond with any of SEQ ID NOS 47-175
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSGGGGSGGGGSGGGGSGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 86 - protein, 493 aa, Artificial Sequence
  Description of Artificial Sequence: Synthetic polypeptide
  Multivalent CD20-binding molecule component 40
  MISC_FEATURE (484)..(484): Cys residue at this position is available to form a homodimer or heterodimer via a disulfide bond with any of SEQ ID NOS 47-175
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKGGGGSGGKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 87 - protein, 508 aa, Artificial Sequence
  Description of Artificial Sequence: Synthetic polypeptide
  Multivalent CD20-binding molecule component 41
  MISC_FEATURE (503)..(503): Cys residue at this position is available to form a homodimer or heterodimer via a disulfide bond with any of SEQ ID NOS 47-175
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHAS

SEQ ID NO: 88 - protein, 512 aa, Artificial Sequence; identical to SEQ ID NO: 82
  Description of Artificial Sequence: Synthetic polypeptide
  Multivalent CD20-binding molecule component 42
  MISC_FEATURE (503)..(503): Cys residue at this position is available to form a homodimer or heterodimer via a disulfide bond with any of SEQ ID NOS 47-175

SEQ ID NO: 89 - protein, 521 aa, Artificial Sequence
  Description of Artificial Sequence: Synthetic polypeptide
  Multivalent CD20-binding molecule component 43
  MISC_FEATURE (512)..(512): Cys residue at this position is available to form a homodimer or heterodimer via a disulfide bond with any of SEQ ID NOS 47-175
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASKDEL

SEQ ID NO: 90 - protein, 511 aa, Artificial Sequence
  Description of Artificial Sequence: Synthetic polypeptide
  Multivalent CD20-binding molecule component 44
  MISC_FEATURE (502)..(502): Cys residue at this position is available to form a homodimer or heterodimer via a disulfide bond with any of SEQ ID NOS 47-175
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 91 - protein, 501 aa, Artificial Sequence
  Description of Artificial Sequence: Synthetic polypeptide
  Multivalent CD20-binding molecule component 45
  MISC_FEATURE (492)..(492): Cys residue at this position is available to form a homodimer or heterodimer via a disulfide bond with any of SEQ ID NOS 47-175
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 92 - protein, 511 aa, Artificial Sequence
  Description of Artificial Sequence: Synthetic polypeptide
  Multivalent CD20-binding molecule component 46
  MISC_FEATURE (502)..(502): Cys residue at this position is available to form a homodimer or heterodimer via a disulfide bond with any of SEQ ID NOS 47-175
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 93 - protein, 511 aa, Artificial Sequence
  Description of Artificial Sequence: Synthetic polypeptide
  Multivalent CD20-binding molecule component 47
  MISC_FEATURE (502)..(502): Cys residue at this position is available to form a homodimer or heterodimer via a disulfide bond with any of SEQ ID NOS 47-175
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 94 - protein, 512 aa, Artificial Sequence
  Description of Artificial Sequence: Synthetic polypeptide
  Multivalent CD20-binding molecule component 48
  MISC_FEATURE (503)..(503): Cys residue at this position is available to form a homodimer or heterodimer via a disulfide bond with any of SEQ ID NOS 47-175
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 95 - protein, 521 aa, Artificial Sequence
  Description of Artificial Sequence: Synthetic polypeptide
  Multivalent CD20-binding molecule component 49
  MISC_FEATURE (512)..(512): Cys residue at this position is available to form a homodimer or heterodimer via a disulfide bond with any of SEQ ID NOS 47-175
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 96 - protein, 514 aa, Artificial Sequence
  Description of Artificial Sequence: Synthetic polypeptide
  Multivalent CD20-binding molecule component 50
  MISC_FEATURE (501)..(501): Cys residue at this position is available to form a homodimer or heterodimer via a disulfide bond with any of SEQ ID NOS 47-175
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 97 - protein, 511 aa, Artificial Sequence
  Description of Artificial Sequence: Synthetic polypeptide
  Multivalent CD20-binding molecule component 51
  MISC_FEATURE (502)..(502): Cys residue at this position is available to form a homodimer or heterodimer via a disulfide bond with any of SEQ ID NOS 47-175
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGGGSGGGGSGGGGSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 98 - protein, 511 aa, Artificial Sequence
  Description of Artificial Sequence: Synthetic polypeptide
  Multivalent CD20-binding molecule component 52
  MISC_FEATURE (502)..(502): Cys residue at this position is available to form a homodimer or heterodimer via a disulfide bond with any of SEQ ID NOS 47-175
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGGGSGGGGSGGGGSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 99 - protein, 497 aa, Artificial Sequence
  Description of Artificial Sequence: Synthetic polypeptide
  Multivalent CD20-binding molecule component 53
  MISC_FEATURE (492)..(492): Cys residue at this position is available to form a homodimer or heterodimer via a disulfide bond with any of SEQ ID NOS 47-175
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHAS

SEQ ID NO: 100 - protein, 491 aa, Artificial Sequence
  Description of Artificial Sequence: Synthetic polypeptide
  Multivalent CD20-binding molecule component 54
  MISC_FEATURE (482)..(482): Cys residue at this position is available to form a homodimer or heterodimer via a disulfide bond with any of SEQ ID NOS 47-175
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 101 - protein, 506 aa, Artificial Sequence
  Description of Artificial Sequence: Synthetic polypeptide
  Multivalent CD20-binding molecule component 55
  MISC_FEATURE (501)..(501): Cys residue at this position is available to form a homodimer or heterodimer via a disulfide bond with any of SEQ ID NOS 47-175
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHAS

SEQ ID NO: 102 - protein, 510 aa, Artificial Sequence
  Description of Artificial Sequence: Synthetic polypeptide
  Multivalent CD20-binding molecule component 56
  MISC_FEATURE (501)..(501): Cys residue at this position is available to form a homodimer or heterodimer via a disulfide bond with any of SEQ ID NOS 47-175
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 103 - protein, 501 aa, Artificial Sequence
  Description of Artificial Sequence: Synthetic polypeptide
  Multivalent CD20-binding molecule component 57
  MISC_FEATURE (492)..(492): Cys residue at this position is available to form a homodimer or heterodimer via a disulfide bond with any of SEQ ID NOS 47-175
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 104 - protein, 501 aa, Artificial Sequence
  Description of Artificial Sequence: Synthetic polypeptide
  Multivalent CD20-binding molecule component 58
  MISC_FEATURE (492)..(492): Cys residue at this position is available to form a homodimer or heterodimer via a disulfide bond with any of SEQ ID NOS 47-175
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 105 - protein, 491 aa, Artificial Sequence
  Description of Artificial Sequence: Synthetic polypeptide
  Multivalent CD20-binding molecule component 59
  MISC_FEATURE (482)..(482): Cys residue at this position is available to form a homodimer or heterodimer via a disulfide bond with any of SEQ ID NOS 47-175
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 106 - protein, 524 aa, Artificial Sequence
  Description of Artificial Sequence: Synthetic polypeptide
  Multivalent CD20-binding molecule component 60
  MISC_FEATURE (511)..(511): Cys residue at this position is available to form a homodimer or heterodimer via a disulfide bond with any of SEQ ID NOS 47-175
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGGGSGGGGSGGGGSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 107 - protein, 491 aa, Artificial Sequence
  Description of Artificial Sequence: Synthetic polypeptide
  Multivalent CD20-binding molecule component 61
  MISC_FEATURE (482)..(482): Cys residue at this position is available to form a homodimer or heterodimer via a disulfide bond with any of SEQ ID NOS 47-175
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 108 - protein, 513 aa, Artificial Sequence
  Description of Artificial Sequence: Synthetic polypeptide
  Multivalent CD20-binding molecule component 62
  MISC_FEATURE (504)..(504): Cys residue at this position is available to form a homodimer or heterodimer via a disulfide bond with any of SEQ ID NOS 47-175
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGSTSGSGKPGSGEGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 109 - protein, 522 aa, Artificial Sequence
  Description of Artificial Sequence: Synthetic polypeptide
  Multivalent CD20-binding molecule component 63
  MISC_FEATURE (513)..(513): Cys residue at this position is available to form a homodimer or heterodimer via a disulfide bond with any of SEQ ID NOS 47-175
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGSTSGSGKPGSGEGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 110 - protein, 512 aa, Artificial Sequence
  Description of Artificial Sequence: Synthetic polypeptide
  Multivalent CD20-binding molecule component 64
  MISC_FEATURE (503)..(503): Cys residue at this position is available to form a homodimer or heterodimer via a disulfide bond with any of SEQ ID NOS 47-175
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKEFPKPSTPPGSSGGAPGILGFVFTLKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 111 - protein, 508 aa, Artificial Sequence
  Description of Artificial Sequence: Synthetic polypeptide
  Multivalent CD20-binding molecule component 65
  MISC_FEATURE (503)..(503): Cys residue at this position is available to form a homodimer or heterodimer via a disulfide bond with any of SEQ ID NOS 47-175
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKEFPKPSTPPGSSGGAPGILGFVFTLKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHAS

SEQ ID NO: 112 - protein, 503 aa, Artificial Sequence
  Description of Artificial Sequence: Synthetic polypeptide
  Multivalent CD20-binding molecule component 66
  MISC_FEATURE (494)..(494): Cys residue at this position is available to form a homodimer or heterodimer via a disulfide bond with any of SEQ ID NOS 47-175
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 113 - protein, 500 aa, Artificial Sequence
  Description of Artificial Sequence: Synthetic polypeptide
  Multivalent CD20-binding molecule component 67
  MISC_FEATURE (495)..(495): Cys residue at this position is available to form a homodimer or heterodimer via a disulfide bond with any of SEQ ID NOS 47-175
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGSTSGSGKPGSGEGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHAS

SEQ ID NO: 114 - protein, 513 aa, Artificial Sequence
  Description of Artificial Sequence: Synthetic polypeptide
  Multivalent CD20-binding molecule component 68
  MISC_FEATURE (504)..(504): Cys residue at this position is available to form a homodimer or heterodimer via a disulfide bond with any of SEQ ID NOS 47-175
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 115 - protein, 516 aa, Artificial Sequence
  Description of Artificial Sequence: Synthetic polypeptide
  Multivalent CD20-binding molecule component 69
  MISC_FEATURE (503)..(503): Cys residue at this position is available to form a homodimer or heterodimer via a disulfide bond with any of SEQ ID NOS 47-175
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARKDEL

SEQ ID NO: 116 - protein, 522 aa, Artificial Sequence
  Description of Artificial Sequence: Synthetic polypeptide
  Multivalent CD20-binding molecule component 70
  MISC_FEATURE (513)..(513): Cys residue at this position is available to form a homodimer or heterodimer via a disulfide bond with any of SEQ ID NOS 47-175
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSEFPKPSTPPGSSGGAPGILGFVFTLKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 117 - protein, 522 aa, Artificial Sequence
  Description of Artificial Sequence: Synthetic polypeptide
  Multivalent CD20-binding molecule component 71
  MISC_FEATURE (513)..(513): Cys residue at this position is available to form a homodimer or heterodimer via a disulfide bond with any of SEQ ID NOS 47-175
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSEFPKPSTPPGSSGGAPGILGFVFTLKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 118 - protein, 503 aa, Artificial Sequence
  Description of Artificial Sequence: Synthetic polypeptide
  Multivalent CD20-binding molecule component 72
  MISC_FEATURE (494)..(494): Cys residue at this position is available to form a homodimer or heterodimer via a disulfide bond with any of SEQ ID NOS 47-175
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 119 - protein, 514 aa, Artificial Sequence
  Description of Artificial Sequence: Synthetic polypeptide
  Multivalent CD20-binding molecule component 73
  MISC_FEATURE (505)..(505): Cys residue at this position is available to form a homodimer or heterodimer via a disulfide bond with any of SEQ ID NOS 47-175
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSGGGGSGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 120 - protein, 520 aa, Artificial Sequence
  Description of Artificial Sequence: Synthetic polypeptide
  Multivalent CD20-binding molecule component 74
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGGGSGGGGSGGGGSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKS

SEQ ID NO: 121 - protein, 510 aa, Artificial Sequence
  Description of Artificial Sequence: Synthetic polypeptide
  Multivalent CD20-binding molecule component 75
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKS

SEQ ID NO: 122 - protein, 500 aa, Artificial Sequence
  Description of Artificial Sequence: Synthetic polypeptide
  Multivalent CD20-binding molecule component 76
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGTGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAREFPKPSTPPGSSGGAPQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKS

SEQ ID NO: 123 - protein, 511 aa, Artificial Sequence
  Description of Artificial Sequence: Synthetic polypeptide
  Multivalent CD20-binding molecule component 77
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVARGGGGSGGQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGGGSGGGGSGGGGSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKS

SEQ ID NO: 124 - protein, 501 aa, Artificial Sequence
  Description of Artificial Sequence: Synthetic polypeptide
  Multivalent CD20-binding molecule component 78
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKS

SEQ ID NO: 125 - protein, 521 aa, Artificial Sequence
  Description of Artificial Sequence: Synthetic polypeptide
  Multivalent CD20-binding molecule component 79
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 126 - protein, 511 aa, Artificial Sequence
  Description of Artificial Sequence: Synthetic polypeptide
  Multivalent CD20-binding molecule component 80
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 127 - protein, 501 aa, Artificial Sequence
  Description of Artificial Sequence: Synthetic polypeptide
  Multivalent CD20-binding molecule component 81
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 128 - protein, 512 aa, Artificial Sequence
  Description of Artificial Sequence: Synthetic polypeptide
  Multivalent CD20-binding molecule component 82
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 129 - protein, 502 aa, Artificial Sequence
  Description of Artificial Sequence: Synthetic polypeptide
  Multivalent CD20-binding molecule component 83
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 130 - protein, 492 aa, Artificial Sequence
  Description of Artificial Sequence: Synthetic polypeptide
  Multivalent CD20-binding molecule component 84
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 131 - protein, 517 aa, Artificial Sequence
  Description of Artificial Sequence: Synthetic polypeptide
  Multivalent CD20-binding molecule component 85
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 132 - protein, 511 aa, Artificial Sequence
  Description of Artificial Sequence: Synthetic polypeptide
  Multivalent CD20-binding molecule component 86
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 133 - protein, 524 aa, Artificial Sequence
  Description of Artificial Sequence: Synthetic polypeptide
  Multivalent CD20-binding molecule component 87
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 134 - protein, 514 aa, Artificial Sequence
  Description of Artificial Sequence: Synthetic polypeptide
  Multivalent CD20-binding molecule component 88
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 135 - protein, 504 aa, Artificial Sequence
  Description of Artificial Sequence: Synthetic polypeptide
  Multivalent CD20-binding molecule component 89
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 136 - protein, 515 aa, Artificial Sequence
  Description of Artificial Sequence: Synthetic polypeptide
  Multivalent CD20-binding molecule component 90
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 137 - protein, 505 aa, Artificial Sequence
  Description of Artificial Sequence: Synthetic polypeptide
  Multivalent CD20-binding molecule component 91
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 138 - protein, 495 aa, Artificial Sequence
  Description of Artificial Sequence: Synthetic polypeptide
  Multivalent CD20-binding molecule component 92
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 139 - protein, 520 aa, Artificial Sequence
  Description of Artificial Sequence: Synthetic polypeptide
  Multivalent CD20-binding molecule component 93
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 140 - protein, 514 aa, Artificial Sequence
  Description of Artificial Sequence: Synthetic polypeptide
  Multivalent CD20-binding molecule component 94
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 141 - protein, 513 aa, Artificial Sequence
  Description of Artificial Sequence: Synthetic polypeptide
  Multivalent CD20-binding molecule component 95
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGSTSGSGKPGSGEGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 142 - protein, 494 aa, Artificial Sequence
  Description of Artificial Sequence: Synthetic polypeptide
  Multivalent CD20-binding molecule component 96
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 143 - protein, 523 aa, Artificial Sequence
  Description of Artificial Sequence: Synthetic polypeptide
  Multivalent CD20-binding molecule component 97
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSGGGGSGGGGSGGGGSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 144 - protein, 503 aa, Artificial Sequence
  Description of Artificial Sequence: Synthetic polypeptide
  Multivalent CD20-binding molecule component 98
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAREFPKPSTPPGSSGGAPQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 145 - protein, 513 aa, Artificial Sequence
  Description of Artificial Sequence: Synthetic polypeptide
  Multivalent CD20-binding molecule component 99
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGSTSGSGKPGSGEGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 146 - protein, 513 aa, Artificial Sequence
  Description of Artificial Sequence: Synthetic polypeptide
  Multivalent CD20-binding molecule component 100
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 147 - protein, 514 aa, Artificial Sequence
  Description of Artificial Sequence: Synthetic polypeptide
  Multivalent CD20-binding molecule component 101
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSGGGGSGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 148 - protein, 494 aa, Artificial Sequence
  Description of Artificial Sequence: Synthetic polypeptide
  Multivalent CD20-binding molecule component 102
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 149 - protein, 509 aa, Artificial Sequence
  Description of Artificial Sequence: Synthetic polypeptide
  Multivalent CD20-binding molecule component 103
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASEFPKPSTPPGSSGGAPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 150 - protein, 513 aa, Artificial Sequence
  Description of Artificial Sequence: Synthetic polypeptide
  Multivalent CD20-binding molecule component 104
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 151 - protein, 509 aa, Artificial Sequence
  Description of Artificial Sequence: Synthetic polypeptide
  Multivalent CD20-binding molecule component 105
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASEFPKPSTPPGSSGGAPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 152 - protein, 510 aa, Artificial Sequence
  Description of Artificial Sequence: Synthetic polypeptide
  Multivalent CD20-binding molecule component 106
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 153 - protein, 500 aa, Artificial Sequence
  Description of Artificial Sequence: Synthetic polypeptide
  Multivalent CD20-binding molecule component 107
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 154 - protein, 510 aa, Artificial Sequence
  Description of Artificial Sequence: Synthetic polypeptide
  Multivalent CD20-binding molecule component 108
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 155 - protein, 510 aa, Artificial Sequence
  Description of Artificial Sequence: Synthetic polypeptide
  Multivalent CD20-binding molecule component 109
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAREFPKPSTPPGSSGGAPQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 156 - protein, 511 aa, Artificial Sequence
  Description of Artificial Sequence: Synthetic polypeptide
  Multivalent CD20-binding molecule component 110
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGGGSGGGGSGGGGSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 157 - protein, 510 aa, Artificial Sequence
  Description of Artificial Sequence: Synthetic polypeptide
  Multivalent CD20-binding molecule component 111
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 158 - protein, 511 aa, Artificial Sequence
  Description of Artificial Sequence: Synthetic polypeptide
  Multivalent CD20-binding molecule component 112
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 159 - protein, 512 aa, Artificial Sequence
  Description of Artificial Sequence: Synthetic polypeptide
  Multivalent CD20-binding molecule component 113
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 160 - protein, 512 aa, Artificial Sequence
  Description of Artificial Sequence: Synthetic polypeptide
  Multivalent CD20-binding molecule component 114
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 161 - protein, 498 aa, Artificial Sequence
  Description of Artificial Sequence: Synthetic polypeptide
  Multivalent CD20-binding molecule component 115
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASGGGGSGGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 162 - protein, 492 aa, Artificial Sequence
  Description of Artificial Sequence: Synthetic polypeptide
  Multivalent CD20-binding molecule component 116
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 163 - protein, 507 aa, Artificial Sequence
  Description of Artificial Sequence: Synthetic polypeptide
  Multivalent CD20-binding molecule component 117
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASEFPKPSTPPGSSGGAPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 164 - protein, 512 aa, Artificial Sequence
  Description of Artificial Sequence: Synthetic polypeptide
  Multivalent CD20-binding molecule component 118
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 165 - protein, 503 aa, Artificial Sequence
  Description of Artificial Sequence: Synthetic polypeptide
  Multivalent CD20-binding molecule component 119
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 166 - protein, 503 aa, Artificial Sequence
  Description of Artificial Sequence: Synthetic polypeptide
  Multivalent CD20-binding molecule component 120
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARGGGGSGGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 167 - protein, 493 aa, Artificial Sequence
  Description of Artificial Sequence: Synthetic polypeptide
  Multivalent CD20-binding molecule component 121
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVARGGGGSGGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 168 - protein, 525 aa, Artificial Sequence
  Description of Artificial Sequence: Synthetic polypeptide
  Multivalent CD20-binding molecule component 122
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSGGGGSGGGGSGGGGSGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKDEL

SEQ ID NO: 169 - protein, 493 aa, Artificial Sequence
  Description of Artificial Sequence: Synthetic polypeptide
  Multivalent CD20-binding molecule component 123
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAGGGGSGGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 170 - protein, 509 aa, Artificial Sequence
  Description of Artificial Sequence: Synthetic polypeptide
  Multivalent CD20-binding molecule component 124
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELK

SEQ ID NO: 171 - protein, 499 aa, Artificial Sequence
  Description of Artificial Sequence: Synthetic polypeptide
  Multivalent CD20-binding molecule component 125
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELK

SEQ ID NO: 172 - protein, 496 aa, Artificial Sequence
  Description of Artificial Sequence: Synthetic polypeptide
  Multivalent CD20-binding molecule component 126
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASGGGGSGGQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELK

SEQ ID NO: 173 - protein, 512 aa, Artificial Sequence; identical to SEQ ID NO: 164
  Description of Artificial Sequence: Synthetic polypeptide
  Multivalent CD20-binding molecule component 127
  MISC_FEATURE (242)..(242): Cys residue at this position is available to form a homodimer or heterodimer via a disulfide bond with any of SEQ ID NOS 47-175

SEQ ID NO: 174 - protein, 502 aa, Artificial Sequence
  Description of Artificial Sequence: Synthetic polypeptide
  Multivalent CD20-binding molecule component 128
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 175 - protein, 488 aa, Artificial Sequence
  Description of Artificial Sequence: Synthetic polypeptide
  Multivalent CD20-binding molecule component 129
  MISC_FEATURE (242)..(242): Cys residue at this position is available to form a homodimer or heterodimer via a disulfide bond with any of SEQ ID NOS 47-175
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAGGGGSGGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSGGGGSGGGGSGGGGSGGGGSTKGQIVLSQSPAILSASPGEKVTMTCRASSSVSYIHWFQQKPGSSPKPWIYATSNLASGVPVRFSGSGSGTSYSLTISRVEAED

SEQ ID NO: 176 - protein, 519 aa, Artificial Sequence
  Description of Artificial Sequence: Synthetic polypeptide
  Multivalent CD20-binding molecule component 130
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSGGGGSGGGGSGGGGSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 177 - protein, 509 aa, Artificial Sequence
  Description of Artificial Sequence: Synthetic polypeptide
  Multivalent CD20-binding molecule component 131
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 178 - protein, 499 aa, Artificial Sequence
  Description of Artificial Sequence: Synthetic polypeptide
  Multivalent CD20-binding molecule component 132
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGTGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 179 - protein, 514 aa, Artificial Sequence
  Description of Artificial Sequence: Synthetic polypeptide
  Multivalent CD20-binding molecule component 133
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSGGGGSGGGGSGGGGSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVARKDEL

SEQ ID NO: 180 - protein, 500 aa, Artificial Sequence
  Description of Artificial Sequence: Synthetic polypeptide
  Multivalent CD20-binding molecule component 134
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 181 - protein, 508 aa, Artificial Sequence
  Description of Artificial Sequence: Synthetic polypeptide
  Multivalent CD20-binding molecule component 135
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 182 - protein, 521 aa, Artificial Sequence
  Description of Artificial Sequence: Synthetic polypeptide
  Multivalent CD20-binding molecule component 136
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 183 - protein, 512 aa, Artificial Sequence
  Description of Artificial Sequence: Synthetic polypeptide
  Multivalent CD20-binding molecule component 137
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 184 - protein, 511 aa, Artificial Sequence
  Description of Artificial Sequence: Synthetic polypeptide
  Multivalent CD20-binding molecule component 138
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 185 - protein, 501 aa, Artificial Sequence
  Description of Artificial Sequence: Synthetic polypeptide
  Multivalent CD20-binding molecule component 139
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 186 - protein, 512 aa, Artificial Sequence
  Description of Artificial Sequence: Synthetic polypeptide
  Multivalent CD20-binding molecule component 140
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 187 - protein, 502 aa, Artificial Sequence
  Description of Artificial Sequence: Synthetic polypeptide
  Multivalent CD20-binding molecule component 141
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 188 - protein, 530 aa, Artificial Sequence
  Description of Artificial Sequence: Synthetic polypeptide
  Multivalent CD20-binding molecule component 142
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 189 - protein, 520 aa, Artificial Sequence
  Description of Artificial Sequence: Synthetic polypeptide
  Multivalent CD20-binding molecule component 143
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 190 - protein, 510 aa, Artificial Sequence
  Description of Artificial Sequence: Synthetic polypeptide
  Multivalent CD20-binding molecule component 144
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 191 - protein, 492 aa, Artificial Sequence
  Description of Artificial Sequence: Synthetic polypeptide
  Multivalent CD20-binding molecule component 145
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 192 - protein, 517 aa, Artificial Sequence
  Description of Artificial Sequence: Synthetic polypeptide
  Multivalent CD20-binding molecule component 146
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHAS

SEQ ID NO: 193 - protein, 511 aa, Artificial Sequence
  Description of Artificial Sequence: Synthetic polypeptide
  Multivalent CD20-binding molecule component 147
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 194 - protein, 526 aa, Artificial Sequence
  Description of Artificial Sequence: Synthetic polypeptide
  Multivalent CD20-binding molecule component 148
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHAS

SEQ ID NO: 195 - protein, 525 aa, Artificial Sequence
  Description of Artificial Sequence: Synthetic polypeptide
  Multivalent CD20-binding molecule component 149
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 196 - protein, 515 aa, Artificial Sequence
  Description of Artificial Sequence: Synthetic polypeptide
  Multivalent CD20-binding molecule component 150
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 197 - protein, 505 aa, Artificial Sequence
  Description of Artificial Sequence: Synthetic polypeptide
  Multivalent CD20-binding molecule component 151
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 198 - protein, 516 aa, Artificial Sequence
  Description of Artificial Sequence: Synthetic polypeptide
  Multivalent CD20-binding molecule component 152
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 199 - protein, 506 aa, Artificial Sequence
  Description of Artificial Sequence: Synthetic polypeptide
  Multivalent CD20-binding molecule component 153
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 200 - protein, 534 aa, Artificial Sequence
  Description of Artificial Sequence: Synthetic polypeptide
  Multivalent CD20-binding molecule component 154
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 201 - protein, 524 aa, Artificial Sequence
  Description of Artificial Sequence: Synthetic polypeptide
  Multivalent CD20-binding molecule component 155
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 202 - protein, 514 aa, Artificial Sequence
  Description of Artificial Sequence: Synthetic polypeptide
  Multivalent CD20-binding molecule component 156
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 203 - protein, 496 aa, Artificial Sequence
  Description of Artificial Sequence: Synthetic polypeptide
  Multivalent CD20-binding molecule component 157
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 204 - protein, 521 aa, Artificial Sequence
  Description of Artificial Sequence: Synthetic polypeptide
  Multivalent CD20-binding molecule component 158
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASKDEL

SEQ ID NO: 205 - protein, 515 aa, Artificial Sequence
  Description of Artificial Sequence: Synthetic polypeptide
  Multivalent CD20-binding molecule component 159
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 206 - protein, 530 aa, Artificial Sequence
  Description of Artificial Sequence: Synthetic polypeptide
  Multivalent CD20-binding molecule component 160
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASKDEL

SEQ ID NO: 207 - protein, 512 aa, Artificial Sequence
  Description of Artificial Sequence: Synthetic polypeptide
  Multivalent CD20-binding molecule component 161
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 208 - protein, 493 aa, Artificial Sequence
  Description of Artificial Sequence: Synthetic polypeptide
  Multivalent CD20-binding molecule component 162
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 209 - protein, 526 aa, Artificial Sequence
  Description of Artificial Sequence: Synthetic polypeptide
  Multivalent CD20-binding molecule component 163
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSGGGGSGGGGSGGGGSGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 210 - protein, 502 aa, Artificial Sequence
  Description of Artificial Sequence: Synthetic polypeptide
  Multivalent CD20-binding molecule component 164
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 211 - protein, 512 aa, Artificial Sequence
  Description of Artificial Sequence: Synthetic polypeptide
  Multivalent CD20-binding molecule component 165
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 212 - protein, 521 aa, Artificial Sequence
  Description of Artificial Sequence: Synthetic polypeptide
  Multivalent CD20-binding molecule component 166
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 213 - protein, 512 aa, Artificial Sequence; identical to SEQ ID NO: 207
  Description of Artificial Sequence: Synthetic polypeptide
  Multivalent CD20-binding molecule component 167

SEQ ID NO: 214 - protein, 513 aa, Artificial Sequence
  Description of Artificial Sequence: Synthetic polypeptide
  Multivalent CD20-binding molecule component 168
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSGGGGSGGGGSGGGGSGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 215 - protein, 493 aa, Artificial Sequence
  Description of Artificial Sequence: Synthetic polypeptide
  Multivalent CD20-binding molecule component 169
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKGGGGSGGKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 216 - protein, 508 aa, Artificial Sequence
  Description of Artificial Sequence: Synthetic polypeptide
  Multivalent CD20-binding molecule component 170
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHAS

SEQ ID NO: 217 - protein, 512 aa, Artificial Sequence; identical to SEQ ID NO: 211
  Description of Artificial Sequence: Synthetic polypeptide
  Multivalent CD20-binding molecule component 171

SEQ ID NO: 218 - protein, 517 aa, Artificial Sequence
  Description of Artificial Sequence: Synthetic polypeptide
  Multivalent CD20-binding molecule component 172
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHAS

SEQ ID NO: 219 - protein, 511 aa, Artificial Sequence
  Description of Artificial Sequence: Synthetic polypeptide
  Multivalent CD20-binding molecule component 173
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 220 - protein, 501 aa, Artificial Sequence
  Description of Artificial Sequence: Synthetic polypeptide
  Multivalent CD20-binding molecule component 174
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 221 - protein, 511 aa, Artificial Sequence
  Description of Artificial Sequence: Synthetic polypeptide
  Multivalent CD20-binding molecule component 175
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 222 - protein, 511 aa, Artificial Sequence
  Description of Artificial Sequence: Synthetic polypeptide
  Multivalent CD20-binding molecule component 176
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 223 - protein, 512 aa, Artificial Sequence
  Description of Artificial Sequence: Synthetic polypeptide
  Multivalent CD20-binding molecule component 177
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 224 - protein, 521 aa, Artificial Sequence
  Description of Artificial Sequence: Synthetic polypeptide
  Multivalent CD20-binding molecule component 178
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 225 - protein, 514 aa, Artificial Sequence
  Description of Artificial Sequence: Synthetic polypeptide
  Multivalent CD20-binding molecule component 179
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 226 - protein, 511 aa, Artificial Sequence
  Description of Artificial Sequence: Synthetic polypeptide
  Multivalent CD20-binding molecule component 180
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGGGSGGGGSGGGGSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 227 - protein, 511 aa, Artificial Sequence
  Description of Artificial Sequence: Synthetic polypeptide
  Multivalent CD20-binding molecule component 181
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGGGSGGGGSGGGGSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 228 - protein, 497 aa, Artificial Sequence
  Description of Artificial Sequence: Synthetic polypeptide
  Multivalent CD20-binding molecule component 182
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHAS

SEQ ID NO: 229 - protein, 491 aa, Artificial Sequence
  Description of Artificial Sequence: Synthetic polypeptide
  Multivalent CD20-binding molecule component 183
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 230 - protein, 506 aa, Artificial Sequence
  Description of Artificial Sequence: Synthetic polypeptide
  Multivalent CD20-binding molecule component 184
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHAS

SEQ ID NO: 231 - protein, 510 aa, Artificial Sequence
  Description of Artificial Sequence: Synthetic polypeptide
  Multivalent CD20-binding molecule component 185
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 232 - protein, 501 aa, Artificial Sequence; identical to SEQ ID NO: 103
  Description of Artificial Sequence: Synthetic polypeptide
  Multivalent CD20-binding molecule component 186

SEQ ID NO: 233 - protein, 501 aa, Artificial Sequence
  Description of Artificial Sequence: Synthetic polypeptide
  Multivalent CD20-binding molecule component 187
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 234 - protein, 491 aa, Artificial Sequence
  Description of Artificial Sequence: Synthetic polypeptide
  Multivalent CD20-binding molecule component 188
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 235 - protein, 524 aa, Artificial Sequence
  Description of Artificial Sequence: Synthetic polypeptide
  Multivalent CD20-binding molecule component 189
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGGGSGGGGSGGGGSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 236 - protein, 491 aa, Artificial Sequence
  Description of Artificial Sequence: Synthetic polypeptide
  Multivalent CD20-binding molecule component 190
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 237 - protein, 513 aa, Artificial Sequence
  Description of Artificial Sequence: Synthetic polypeptide
  Multivalent CD20-binding molecule component 191
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGSTSGSGKPGSGEGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 238 - protein, 522 aa, Artificial Sequence
  Description of Artificial Sequence: Synthetic polypeptide
  Multivalent CD20-binding molecule component 192
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGSTSGSGKPGSGEGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 239 - protein, 512 aa, Artificial Sequence
  Description of Artificial Sequence: Synthetic polypeptide
  Multivalent CD20-binding molecule component 193
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKEFPKPSTPPGSSGGAPGILGFVFTLKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 240 - protein, 508 aa, Artificial Sequence
  Description of Artificial Sequence: Synthetic polypeptide
  Multivalent CD20-binding molecule component 194
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKEFPKPSTPPGSSGGAPGILGFVFTLKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHAS

SEQ ID NO: 241 - protein, 503 aa, Artificial Sequence
  Description of Artificial Sequence: Synthetic polypeptide
  Multivalent CD20-binding molecule component 195
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 242 - protein, 500 aa, Artificial Sequence
  Description of Artificial Sequence: Synthetic polypeptide
  Multivalent CD20-binding molecule component 196
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGSTSGSGKPGSGEGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHAS

SEQ ID NO: 243 - protein, 513 aa, Artificial Sequence
  Description of Artificial Sequence: Synthetic polypeptide
  Multivalent CD20-binding molecule component 197
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 244 - protein, 516 aa, Artificial Sequence
  Description of Artificial Sequence: Synthetic polypeptide
  Multivalent CD20-binding molecule component 198
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSEFPKPSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARKDEL

SEQ ID NO: 245 - protein, 522 aa, Artificial Sequence
  Description of Artificial Sequence: Synthetic polypeptide
  Multivalent CD20-binding molecule component 199
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSEFPKPSTPPGSSGGAPGILGFVFTLKEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 246 - protein, 522 aa, Artificial Sequence
  Description of Artificial Sequence: Synthetic polypeptide
  Multivalent CD20-binding molecule component 200
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSEFPKPSTPPGSSGGAPGILGFVFTLKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 247 - protein, 503 aa, Artificial Sequence
  Description of Artificial Sequence: Synthetic polypeptide
  Multivalent CD20-binding molecule component 201
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSEFPKPSTPPGSSGGAPKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 248 - protein, 514 aa, Artificial Sequence
  Description of Artificial Sequence: Synthetic polypeptide
  Multivalent CD20-binding molecule component 202
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSGGGGSGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 249 - protein, 520 aa, Artificial Sequence
  Description of Artificial Sequence: Synthetic polypeptide
  Multivalent CD20-binding molecule component 203
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGGGSGGGGSGGGGSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKS

SEQ ID NO: 250 - protein, 510 aa, Artificial Sequence
  Description of Artificial Sequence: Synthetic polypeptide
  Multivalent CD20-binding molecule component 204
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKS

SEQ ID NO: 251 - protein, 500 aa, Artificial Sequence
  Description of Artificial Sequence: Synthetic polypeptide
  Multivalent CD20-binding molecule component 205
KEFTLDFSTAKTYVDSLNVIRSAIGTPLQTISSGGTSLLMIDSGTGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAREFPKPSTPPGSSGGAPQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKS

SEQ ID NO: 252 - protein, 511 aa, Artificial Sequence
  Description of Artificial Sequence: Synthetic polypeptide
  Multivalent CD20-binding molecule component 206
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVARGGGGSGGQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGGGGSGGGGSGGGGSGGGGSGGGGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKS

SEQ ID NO: 253 - protein, 501 aa, Artificial Sequence
  Description of Artificial Sequence: Synthetic polypeptide
  Multivalent CD20-binding molecule component 207
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGSTSGSGKPGSGEGSQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKS

SEQ ID NO: 254 - protein, 521 aa, Artificial Sequence
  Description of Artificial Sequence: Synthetic polypeptide
  Multivalent CD20-binding molecule component 208
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 255 - protein, 511 aa, Artificial Sequence
  Description of Artificial Sequence: Synthetic polypeptide
  Multivalent CD20-binding molecule component 209
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 256 - protein, 501 aa, Artificial Sequence
  Description of Artificial Sequence: Synthetic polypeptide
  Multivalent CD20-binding molecule component 210
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 257 - protein, 512 aa, Artificial Sequence
  Description of Artificial Sequence: Synthetic polypeptide
  Multivalent CD20-binding molecule component 211
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 258 - protein, 502 aa, Artificial Sequence
  Description of Artificial Sequence: Synthetic polypeptide
  Multivalent CD20-binding molecule component 212
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 259 - protein, 492 aa, Artificial Sequence
  Description of Artificial Sequence: Synthetic polypeptide
  Multivalent CD20-binding molecule component 213
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 260 - protein, 517 aa, Artificial Sequence
  Description of Artificial Sequence: Synthetic polypeptide
  Multivalent CD20-binding molecule component 214
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 261 - protein, 511 aa, Artificial Sequence
  Description of Artificial Sequence: Synthetic polypeptide
  Multivalent CD20-binding molecule component 215
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 262 - protein, 524 aa, Artificial Sequence
  Description of Artificial Sequence: Synthetic polypeptide
  Multivalent CD20-binding molecule component 216
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 263 - protein, 514 aa, Artificial Sequence
  Description of Artificial Sequence: Synthetic polypeptide
  Multivalent CD20-binding molecule component 217
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 264 - protein, 504 aa, Artificial Sequence
  Description of Artificial Sequence: Synthetic polypeptide
  Multivalent CD20-binding molecule component 218
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 265 - protein, 515 aa, Artificial Sequence
  Description of Artificial Sequence: Synthetic polypeptide
  Multivalent CD20-binding molecule component 219
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 266 - protein, 505 aa, Artificial Sequence
  Description of Artificial Sequence: Synthetic polypeptide
  Multivalent CD20-binding molecule component 220
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 267 - protein, 495 aa, Artificial Sequence
  Description of Artificial Sequence: Synthetic polypeptide
  Multivalent CD20-binding molecule component 221
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 268 - protein, 520 aa, Artificial Sequence
  Description of Artificial Sequence: Synthetic polypeptide
  Multivalent CD20-binding molecule component 222
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGGGGSGGGGSGGGGSGGGGSGGGGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 269 - protein, 514 aa, Artificial Sequence
  Description of Artificial Sequence: Synthetic polypeptide
  Multivalent CD20-binding molecule component 223
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKDEL

SEQ ID NO: 270 - protein, 513 aa, Artificial Sequence
  Description of Artificial Sequence: Synthetic polypeptide
  Multivalent CD20-binding molecule component 224
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGSTSGSGKPGSGEGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 271 - protein, 497 aa, Artificial Sequence
  Description of Artificial Sequence: Synthetic polypeptide
  Multivalent CD20-binding molecule component 225
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKDEL

SEQ ID NO: 272 - protein, 523 aa, Artificial Sequence
  Description of Artificial Sequence: Synthetic polypeptide
  Multivalent CD20-binding molecule component 226
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSGGGGSGGGGSGGGGSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 273 - protein, 503 aa, Artificial Sequence
  Description of Artificial Sequence: Synthetic polypeptide
  Multivalent CD20-binding molecule component 227
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAREFPKPSTPPGSSGGAPQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 274 - protein, 516 aa, Artificial Sequence
  Description of Artificial Sequence: Synthetic polypeptide
  Multivalent CD20-binding molecule component 228
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGSTSGSGKPGSGEGSDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKDEL

SEQ ID NO: 275 - protein, 513 aa, Artificial Sequence
  Description of Artificial Sequence: Synthetic polypeptide
  Multivalent CD20-binding molecule component 229
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 276 - protein, 514 aa, Artificial Sequence
  Description of Artificial Sequence: Synthetic polypeptide
  Multivalent CD20-binding molecule component 230
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSGGGGSGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 277 - protein, 494 aa, Artificial Sequence
  Description of Artificial Sequence: Synthetic polypeptide
  Multivalent CD20-binding molecule component 231
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 278 - protein, 509 aa, Artificial Sequence
  Description of Artificial Sequence: Synthetic polypeptide
  Multivalent CD20-binding molecule component 232
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASEFPKPSTPPGSSGGAPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 279 - protein, 513 aa, Artificial Sequence
  Description of Artificial Sequence: Synthetic polypeptide
  Multivalent CD20-binding molecule component 233
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 280 - protein, 509 aa, Artificial Sequence
  Description of Artificial Sequence: Synthetic polypeptide
  Multivalent CD20-binding molecule component 234
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASEFPKPSTPPGSSGGAPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKGSTSGSGKPGSGEGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 281 - protein, 510 aa, Artificial Sequence
  Description of Artificial Sequence: Synthetic polypeptide
  Multivalent CD20-binding molecule component 235
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 282 - protein, 500 aa, Artificial Sequence
  Description of Artificial Sequence: Synthetic polypeptide
  Multivalent CD20-binding molecule component 236
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 283 - protein, 510 aa, Artificial Sequence
  Description of Artificial Sequence: Synthetic polypeptide
  Multivalent CD20-binding molecule component 237
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 284 - protein, 510 aa, Artificial Sequence
  Description of Artificial Sequence: Synthetic polypeptide
  Multivalent CD20-binding molecule component 238
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAREFPKPSTPPGSSGGAPQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 285 - protein, 511 aa, Artificial Sequence
  Description of Artificial Sequence: Synthetic polypeptide
  Multivalent CD20-binding molecule component 239
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGGGGSGGGGSGGGGSGGGGSGGGGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 286 - protein, 510 aa, Artificial Sequence
  Description of Artificial Sequence: Synthetic polypeptide
  Multivalent CD20-binding molecule component 240
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKSGSTSGSGKPGSGEGSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 287 - protein, 515 aa, Artificial Sequence
  Description of Artificial Sequence: Synthetic polypeptide
  Multivalent CD20-binding molecule component 241
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSKDEL

SEQ ID NO: 288 - protein, 512 aa, Artificial Sequence
  Description of Artificial Sequence: Synthetic polypeptide
  Multivalent CD20-binding molecule component 242
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 289 - protein, 512 aa, Artificial Sequence
  Description of Artificial Sequence: Synthetic polypeptide
  Multivalent CD20-binding molecule component 243
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 290 - protein, 498 aa, Artificial Sequence
  Description of Artificial Sequence: Synthetic polypeptide
  Multivalent CD20-binding molecule component 244
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASGGGGSGGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 291 - protein, 492 aa, Artificial Sequence
  Description of Artificial Sequence: Synthetic polypeptide
  Multivalent CD20-binding molecule component 245
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 292 - protein, 507 aa, Artificial Sequence
  Description of Artificial Sequence: Synthetic polypeptide
  Multivalent CD20-binding molecule component 246
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASEFPKPSTPPGSSGGAPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGSTSGSGKPGSGEGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 293 - protein, 512 aa, Artificial Sequence
  Description of Artificial Sequence: Synthetic polypeptide
  Multivalent CD20-binding molecule component 247
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 294 - protein, 503 aa, Artificial Sequence; identical to SEQ ID NO: 165
  Description of Artificial Sequence: Synthetic polypeptide
  Multivalent CD20-binding molecule component 248

SEQ ID NO: 295 - protein, 503 aa, Artificial Sequence
  Description of Artificial Sequence: Synthetic polypeptide
  Multivalent CD20-binding molecule component 249
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVARGGGGSGGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 296 - protein, 493 aa, Artificial Sequence
  Description of Artificial Sequence: Synthetic polypeptide
  Multivalent CD20-binding molecule component 250
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVARGGGGSGGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 297 - protein, 525 aa, Artificial Sequence
  Description of Artificial Sequence: Synthetic polypeptide
  Multivalent CD20-binding molecule component 251
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSGGGGSGGGGSGGGGSGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKDEL

SEQ ID NO: 298 - protein, 493 aa, Artificial Sequence
  Description of Artificial Sequence: Synthetic polypeptide
  Multivalent CD20-binding molecule component 252
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAGGGGSGGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 299 - protein, 509 aa, Artificial Sequence
  Description of Artificial Sequence: Synthetic polypeptide
  Multivalent CD20-binding molecule component 253
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELK

SEQ ID NO: 300 - protein, 499 aa, Artificial Sequence
  Description of Artificial Sequence: Synthetic polypeptide
  Multivalent CD20-binding molecule component 254
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELK

SEQ ID NO: 301 - protein, 496 aa, Artificial Sequence
  Description of Artificial Sequence: Synthetic polypeptide
  Multivalent CD20-binding molecule component 255
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASGGGGSGGQVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGSTSGSGKPGSGEGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELK

SEQ ID NO: 302 - protein, 512 aa, Artificial Sequence; identical to SEQ ID NO: 293
  Description of Artificial Sequence: Synthetic polypeptide
  Multivalent CD20-binding molecule component 256

SEQ ID NO: 303 - protein, 502 aa, Artificial Sequence
  Description of Artificial Sequence: Synthetic polypeptide
  Multivalent CD20-binding molecule component 257
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAREFPKPSTPPGSSGGAPQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 304 - protein, 492 aa, Artificial Sequence
  Description of Artificial Sequence: Synthetic polypeptide
  Multivalent CD20-binding molecule component 258
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAGGGGSGGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSGGGGSGGGGSGGGGSGGGGSTKGQIVLSQSPAILSASPGEKVTMTCRASSSVSYIHWFQQKPGSSPKPWIYATSNLASGVPVRFSGSGSGTSYSLTISRVEAEDKDEL

SEQ ID NO: 305 - protein, 4 aa, Artificial Sequence
  Description of Artificial Sequence: Synthetic peptide
KDEL

SEQ ID NO: 306 - protein, 4 aa, Artificial Sequence
  Description of Artificial Sequence: Synthetic peptide
HDEF

SEQ ID NO: 307 - protein, 4 aa, Artificial Sequence
  Description of Artificial Sequence: Synthetic peptide
HDEL

SEQ ID NO: 308 - protein, 4 aa, Artificial Sequence
  Description of Artificial Sequence: Synthetic peptide
RDEF

SEQ ID NO: 309 - protein, 4 aa, Artificial Sequence
  Description of Artificial Sequence: Synthetic peptide
RDEL

SEQ ID NO: 310 - protein, 4 aa, Artificial Sequence
  Description of Artificial Sequence: Synthetic peptide
WDEL

SEQ ID NO: 311 - protein, 4 aa, Artificial Sequence
  Description of Artificial Sequence: Synthetic peptide
YDEL

SEQ ID NO: 312 - protein, 4 aa, Artificial Sequence
  Description of Artificial Sequence: Synthetic peptide
HEEF

SEQ ID NO: 313 - protein, 4 aa, Artificial Sequence
  Description of Artificial Sequence: Synthetic peptide
HEEL

SEQ ID NO: 314 - protein, 4 aa, Artificial Sequence
  Description of Artificial Sequence: Synthetic peptide
KEEL

SEQ ID NO: 315 - protein, 4 aa, Artificial Sequence
  Description of Artificial Sequence: Synthetic peptide
REEL

SEQ ID NO: 316 - protein, 4 aa, Artificial Sequence
  Description of Artificial Sequence: Synthetic peptide
KAEL

SEQ ID NO: 317 - protein, 4 aa, Artificial Sequence
  Description of Artificial Sequence: Synthetic peptide
KCEL

SEQ ID NO: 318 - protein, 4 aa, Artificial Sequence
  Description of Artificial Sequence: Synthetic peptide
KFEL

SEQ ID NO: 319 - protein, 4 aa, Artificial Sequence
  Description of Artificial Sequence: Synthetic peptide
KGEL

SEQ ID NO: 320 - protein, 4 aa, Artificial Sequence
  Description of Artificial Sequence: Synthetic peptide
KHEL

SEQ ID NO: 321 - protein, 4 aa, Artificial Sequence
  Description of Artificial Sequence: Synthetic peptide
KLEL

SEQ ID NO: 322 - protein, 4 aa, Artificial Sequence
  Description of Artificial Sequence: Synthetic peptide
KNEL

SEQ ID NO: 323 - protein, 4 aa, Artificial Sequence
  Description of Artificial Sequence: Synthetic peptide
KQEL

SEQ ID NO: 324 - protein, 4 aa, Artificial Sequence
  Description of Artificial Sequence: Synthetic peptide
KREL

SEQ ID NO: 325 - protein, 4 aa, Artificial Sequence
  Description of Artificial Sequence: Synthetic peptide
KSEL

SEQ ID NO: 326 - protein, 4 aa, Artificial Sequence
  Description of Artificial Sequence: Synthetic peptide
KVEL

SEQ ID NO: 327 - protein, 4 aa, Artificial Sequence
  Description of Artificial Sequence: Synthetic peptide
KWEL

SEQ ID NO: 328 - protein, 4 aa, Artificial Sequence
  Description of Artificial Sequence: Synthetic peptide
KYEL

SEQ ID NO: 329 - protein, 4 aa, Artificial Sequence
  Description of Artificial Sequence: Synthetic peptide
KEDL

SEQ ID NO: 330 - protein, 4 aa, Artificial Sequence
  Description of Artificial Sequence: Synthetic peptide
KIEL

SEQ ID NO: 331 - protein, 4 aa, Artificial Sequence
  Description of Artificial Sequence: Synthetic peptide
DKEL

SEQ ID NO: 332 - protein, 4 aa, Artificial Sequence
  Description of Artificial Sequence: Synthetic peptide
FDEL

SEQ ID NO: 333 - protein, 4 aa, Artificial Sequence
  Description of Artificial Sequence: Synthetic peptide
KDEF

SEQ ID NO: 334 - protein, 4 aa, Artificial Sequence
  Description of Artificial Sequence: Synthetic peptide
KKEL

SEQ ID NO: 335 - protein, 4 aa, Artificial Sequence
  Description of Artificial Sequence: Synthetic peptide
HADL

SEQ ID NO: 336 - protein, 4 aa, Artificial Sequence
  Description of Artificial Sequence: Synthetic peptide
HAEL

SEQ ID NO: 337 - protein, 4 aa, Artificial Sequence
  Description of Artificial Sequence: Synthetic peptide
HIEL

SEQ ID NO: 338 - protein, 4 aa, Artificial Sequence
  Description of Artificial Sequence: Synthetic peptide
HNEL

SEQ ID NO: 339 - protein, 4 aa, Artificial Sequence
  Description of Artificial Sequence: Synthetic peptide
HTEL

SEQ ID NO: 340 - protein, 4 aa, Artificial Sequence
  Description of Artificial Sequence: Synthetic peptide
KTEL

SEQ ID NO: 341 - protein, 4 aa, Artificial Sequence
  Description of Artificial Sequence: Synthetic peptide
HVEL

SEQ ID NO: 342 - protein, 4 aa, Artificial Sequence
  Description of Artificial Sequence: Synthetic peptide
NDEL

SEQ ID NO: 343 - protein, 4 aa, Artificial Sequence
  Description of Artificial Sequence: Synthetic peptide
QDEL

SEQ ID NO: 344 - protein, 4 aa, Artificial Sequence
  Description of Artificial Sequence: Synthetic peptide
REDL

SEQ ID NO: 345 - protein, 4 aa, Artificial Sequence
  Description of Artificial Sequence: Synthetic peptide
RNEL

SEQ ID NO: 346 - protein, 4 aa, Artificial Sequence
  Description of Artificial Sequence: Synthetic peptide
RTDL

SEQ ID NO: 347 - protein, 4 aa, Artificial Sequence
  Description of Artificial Sequence: Synthetic peptide
RTEL

SEQ ID NO: 348 - protein, 4 aa, Artificial Sequence
  Description of Artificial Sequence: Synthetic peptide
SDEL

SEQ ID NO: 349 - protein, 4 aa, Artificial Sequence
  Description of Artificial Sequence: Synthetic peptide
TDEL

SEQ ID NO: 350 - protein, 4 aa, Artificial Sequence
  Description of Artificial Sequence: Synthetic peptide
SKEL

SEQ ID NO: 351 - protein, 4 aa, Artificial Sequence
  Description of Artificial Sequence: Synthetic peptide
STEL

SEQ ID NO: 352 - protein, 4 aa, Artificial Sequence
  Description of Artificial Sequence: Synthetic peptide
EDEL

SEQ ID NO: 353 - protein, 6 aa, Artificial Sequence
  Description of Artificial Sequence: Synthetic peptide
ASGGPE

SEQ ID NO: 354 - protein, 54 aa, Artificial Sequence
  Description of Artificial Sequence: Synthetic polypeptide
  MISC_FEATURE (5)..(6): May or may not be present
  MISC_FEATURE (10)..(11): May or may not be present
  MISC_FEATURE (15)..(16): May or may not be present
  MISC_FEATURE (20)..(21): May or may not be present
  MISC_FEATURE (25)..(26): May or may not be present
  MISC_FEATURE (30)..(31): May or may not be present
  MISC_FEATURE (35)..(36): May or may not be present
  MISC_FEATURE (40)..(41): May or may not be present
  MISC_FEATURE (45)..(46): May or may not be present
  MISC_FEATURE (50)..(51): May or may not be present
  MISC_FEATURE (3)..(52): This region may encompass 1-10 'Gly(2-4)Ser' repeating units
AMGGGGSGGGGSGGGGSGGGGSGGGGSGGGGSGGGGSGGGGSGGGGSGGGGSAM

SEQ ID NO: 355 - protein, 210 aa, Artificial Sequence
  Description of Artificial Sequence: Synthetic polypeptide
  MISC_FEATURE (2)..(6): May or may not be present
  MISC_FEATURE (9)..(13): May or may not be present
  MISC_FEATURE (16)..(20): May or may not be present
  MISC_FEATURE (23)..(27): May or may not be present
  MISC_FEATURE (30)..(34): May or may not be present
  MISC_FEATURE (37)..(41): May or may not be present
  MISC_FEATURE (44)..(48): May or may not be present
  MISC_FEATURE (51)..(55): May or may not be present
  MISC_FEATURE (58)..(62): May or may not be present
  MISC_FEATURE (65)..(69): May or may not be present
  MISC_FEATURE (72)..(76): May or may not be present
  MISC_FEATURE (79)..(83): May or may not be present
  MISC_FEATURE (86)..(90): May or may not be present
  MISC_FEATURE (93)..(97): May or may not be present
  MISC_FEATURE (100)..(104): May or may not be present
  MISC_FEATURE (107)..(111): May or may not be present
  MISC_FEATURE (114)..(118): May or may not be present
  MISC_FEATURE (121)..(125): May or may not be present
  MISC_FEATURE (128)..(132): May or may not be present
  MISC_FEATURE (135)..(139): May or may not be present
  MISC_FEATURE (142)..(146): May or may not be present
  MISC_FEATURE (149)..(153): May or may not be present
  MISC_FEATURE (156)..(160): May or may not be present
  MISC_FEATURE (163)..(167): May or may not be present
  MISC_FEATURE (170)..(174): May or may not be present
  MISC_FEATURE (177)..(181): May or may not be present
  MISC_FEATURE (184)..(188): May or may not be present
  MISC_FEATURE (191)..(195): May or may not be present
  MISC_FEATURE (198)..(202): May or may not be present
  MISC_FEATURE (205)..(209): May or may not be present
  MISC_FEATURE (1)..(210): This sequence may encompass 1-30 '(Gly)X-Ser' repeating units, wherein X represents 1-6
GGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGS

SEQ ID NO: 356 - protein, 210 aa, Artificial Sequence
  Description of Artificial Sequence: Synthetic polypeptide
  MISC_FEATURE (2)..(6): May or may not be present
  MISC_FEATURE (9)..(13): May or may not be present
  MISC_FEATURE (16)..(20): May or may not be present
  MISC_FEATURE (23)..(27): May or may not be present
  MISC_FEATURE (30)..(34): May or may not be present
  MISC_FEATURE (37)..(41): May or may not be present
  MISC_FEATURE (44)..(48): May or may not be present
  MISC_FEATURE (51)..(55): May or may not be present
  MISC_FEATURE (58)..(62): May or may not be present
  MISC_FEATURE (65)..(69): May or may not be present
  MISC_FEATURE (72)..(76): May or may not be present
  MISC_FEATURE (79)..(83): May or may not be present
  MISC_FEATURE (86)..(90): May or may not be present
  MISC_FEATURE (93)..(97): May or may not be present
  MISC_FEATURE (100)..(104): May or may not be present
  MISC_FEATURE (107)..(111): May or may not be present
  MISC_FEATURE (114)..(118): May or may not be present
  MISC_FEATURE (121)..(125): May or may not be present
  MISC_FEATURE (128)..(132): May or may not be present
  MISC_FEATURE (135)..(139): May or may not be present
  MISC_FEATURE (142)..(146): May or may not be present
  MISC_FEATURE (149)..(153): May or may not be present
  MISC_FEATURE (156)..(160): May or may not be present
  MISC_FEATURE (163)..(167): May or may not be present
  MISC_FEATURE (170)..(174): May or may not be present
  MISC_FEATURE (177)..(181): May or may not be present
  MISC_FEATURE (184)..(188): May or may not be present
  MISC_FEATURE (191)..(195): May or may not be present
  MISC_FEATURE (198)..(202): May or may not be present
  MISC_FEATURE (205)..(209): May or may not be present
  MISC_FEATURE (1)..(210): This sequence may encompass 1-30 '(Ser)X-Gly' repeating units, wherein X represents 1-6
SSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSG

SEQ ID NO: 357 - protein, 150 aa, Artificial Sequence
  Description of Artificial Sequence: Synthetic polypeptide
  MISC_FEATURE (1)..(150): This sequence may encompass 1-30 'Gly-Gly-Gly- Gly-Ser' repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 358 - protein, 30 aa, Artificial Sequence
  Description of Artificial Sequence: Synthetic polypeptide
  MISC_FEATURE (2)..(30): May or may not be present
GGGGGGGGGGGGGGGGGGGGGGGGGGGGGG

SEQ ID NO: 359 - protein, 12 aa, Artificial Sequence
  Description of Artificial Sequence: Synthetic peptide
GKSSGSGSESKS

SEQ ID NO: 360 - protein, 14 aa, Artificial Sequence
  Description of Artificial Sequence: Synthetic peptide
EGKSSGSGSESKEF

SEQ ID NO: 361 - protein, 14 aa, Artificial Sequence
  Description of Artificial Sequence: Synthetic peptide
GSTSGSGKSSEGKG

SEQ ID NO: 362 - protein, 18 aa, Artificial Sequence
  Description of Artificial Sequence: Synthetic peptide
GSTSGSGKSSEGSGSTKG

SEQ ID NO: 363 - protein, 18 aa, Artificial Sequence
  Description of Artificial Sequence: Synthetic peptide
GSTSGSGKPGSGEGSTKG

SEQ ID NO: 364 - protein, 5 aa, Artificial Sequence
  Description of Artificial Sequence: Synthetic peptide
SRSSG

SEQ ID NO: 365 - protein, 5 aa, Artificial Sequence
  Description of Artificial Sequence: Synthetic peptide
SGSSC

SEQ ID NO: 366 - protein, 28 aa, Artificial Sequence
  Description of Artificial Sequence: Synthetic peptide
AMGRSGGGCAGNRVGSSLSCGGLNLQAM

SEQ ID NO: 367 - protein, 15 aa, Artificial Sequence
  Description of Artificial Sequence: Synthetic peptide
GGGGSGGGGSGGGGS

SEQ ID NO: 368 - protein, 4 aa, Artificial Sequence
  Description of Artificial Sequence: Synthetic peptide
GGGS

SEQ ID NO: 369 - protein, 8 aa, Artificial Sequence
  Description of Artificial Sequence: Synthetic peptide
GGGGSGGG

SEQ ID NO: 370 - protein, 7 aa, Artificial Sequence
  Description of Artificial Sequence: Synthetic peptide
GGSGGGG

SEQ ID NO: 371 - protein, 18 aa, Artificial Sequence
  Description of Artificial Sequence: Synthetic peptide
GSTSGGGSGGGSGGGGSS

SEQ ID NO: 372 - protein, 18 aa, Artificial Sequence
  Description of Artificial Sequence: Synthetic peptide
GSTSGSGKPGSSEGSTKG

SEQ ID NO: 373 - protein, 5 aa, Artificial Sequence
  Description of Artificial Sequence: Synthetic peptide
GGGGC

SEQ ID NO: 374 - protein, 6 aa, Artificial Sequence
  Description of Artificial Sequence: Synthetic peptide
SGGGGC

The invention is claimed as follows:

1. A cytotoxic composition comprising:
   a) a cytotoxic multivalent CD20-binding molecule, which multivalent CD20-binding molecule is multimeric and comprises or consists of at least two polypeptides linked by at least one covalent bond, each of said polypeptides having at least 98% sequence identity to an amino acid sequence selected from SEQ ID NO: 54 and SEQ ID NO: 55; wherein the cytotoxic multivalent CD20-binding molecule is capable of selectively killing a cell that expresses CD20 at a cellular surface; and
   b) a monovalent CD20-binding molecule, wherein said monovalent CD20-binding molecule consists of a polypeptide having at least 98% sequence identity to an amino acid sequence selected from SEQ ID NO: 54 and SEQ ID NO: 55;

wherein the ratio of the monovalent CD20-binding molecule concentration to the total CD20-binding molecule concentration is less than 1:5.

2. The cytotoxic composition of claim 1, wherein the ratio of the monovalent CD20-binding molecule concentration to the total CD20-binding molecule concentration is less than 1:11.

3. The cytotoxic composition of claim 2, wherein the cytotoxic multivalent CD20-binding molecule is a dimer consisting of two of said polypeptides linked by at least one covalent bond, each having at least 98% sequence identity to an amino acid sequence selected from SEQ ID NO: 54 and SEQ ID NO: 55.

4. The cytotoxic composition of claim 3, wherein the cytotoxic multivalent CD20-binding molecule is a homodimer consisting of two identical polypeptides linked by at least one covalent bond, each having at least 98% sequence identity to an amino acid sequence selected from SEQ ID NO: 54 and SEQ ID NO: 55.

5. The cytotoxic composition of claim 4, wherein the multivalent CD20-binding molecule is a homodimer consisting of two identical polypeptides linked by at least one covalent bond, each having the amino acid sequence of SEQ ID NO: 54.

6. The cytotoxic composition of claim 4, wherein the multivalent CD20-binding molecule is a homodimer consisting of two identical polypeptides linked by at least one covalent bond, each having the amino acid sequence of SEQ ID NO: 55.

7. The cytotoxic composition of claim 4, wherein the ratio of said dimeric CD20-binding molecule concentration to total CD20-binding molecule concentration is greater than 3:4.

8. The composition of claim 7, wherein the ratio of dimeric CD20-binding molecule concentration to total CD20-binding molecule concentration is greater than 7:8.

9. The cytotoxic composition of claim 2, wherein the cytotoxic multivalent CD20-binding molecule is a higher-order multimer that comprises or consists of at least 3, 4, 5, or 6 of said polypeptides, each having at least 98% sequence identity to an amino acid sequence selected from SEQ ID NO: 54 and SEQ ID NO: 55; wherein at least two of said polypeptides are linked by at least one covalent bond.

10. The cytotoxic composition of claim 9, wherein the cytotoxic multivalent CD20-binding molecule is a homomultimer that comprises or consists of at least 3, 4, 5, or 6 identical polypeptides, each having at least 98% sequence identity to an amino acid sequence selected from SEQ ID NO: 54 and SEQ ID NO: 55; wherein at least two of said polypeptides are linked by at least one covalent bond.

11. The cytotoxic composition of claim 10, wherein the cytotoxic multivalent CD20-binding molecule is a homomultimer that comprises or consists of at least 3, 4, 5, or 6 identical polypeptides, each having the amino acid sequence of SEQ ID NO: 54; wherein at least two of said polypeptides are linked by at least one covalent bond.

12. The cytotoxic composition of claim 10, wherein the cytotoxic multivalent CD20-binding molecule is a homomultimer that comprises or consists of at least 3, 4, 5, or 6 identical polypeptides, each having the amino acid sequence of SEQ ID NO: 55; wherein at least two of said polypeptides are linked by at least one covalent bond.

13. The cytotoxic composition of claim 3, wherein, in addition to said dimer, the composition further comprises a cytotoxic multivalent CD20-binding molecule that is a higher-order multimer comprising or consisting of at least 3, 4, 5, or 6 polypeptides, each having at least 98% sequence identity to an amino acid sequence selected from SEQ ID NO: 54 and SEQ ID NO: 55;
wherein at least two of said polypeptides are linked by at least one covalent bond; and
wherein the ratio of said higher-order multimer CD20-binding molecule concentration to total CD20-binding molecule concentration is less than 1:4.

14. The cytotoxic composition of claim 13, wherein the ratio of said higher-order multimer CD20-binding molecule concentration to total CD20-binding molecule concentration is less than 1:7.

15. The cytotoxic composition of any one of claims 1-14, wherein the at least one covalent bond comprises a disulfide bond.

16. The cytotoxic composition of claim 5, wherein the disulfide bond involves a cysteine residue located at amino acid position 503.

17. The cytotoxic composition of claim 6, wherein the disulfide bond involves a cysteine residue located at amino acid position 502.

18. The cytotoxic composition of any one of claims 1-14, wherein administration of the cytotoxic composition to a first population of cells whose members are CD20 positive, and a second population of cells whose members are not CD20 positive, a cytotoxic effect of the cytotoxic composition to members of said first population of cells relative to members of said second population of cells is at least 3-fold greater.

19. The cytotoxic composition of any one of claims 1-14 and 16-17, further comprising:
acetate, alcohol, alpha-tocopherol, aluminum monostearate, ascorbic acid, ascorbyl palmitate, benzyl alcohol, butylated hydroxyanisole, butylated hydroxytoluene, chlorobutanol, citrate, cysteine hydrochloride, dextrose, ethanol, ethylenediaminetetraacetic acid, ethyloleate, gelatin, glycerine, glycerol, lactic acid, lecithin, mannitol, methyl parabens, monostearate salt, organic ester, paraben, phosphate, phosphoric acid, polyalcohol, polyethylene glycol, polyol, propylene glycol, propylgallate, Ringer's solution, saline, sodium bisulfate, sodium bisulfite, sodium chloride, sodium metabisulfite, sodium sulfite, sorbitol, sugar, tartaric acid, or water.

20. The cytotoxic composition of claim 16 or claim 17, further comprising:
citrate, polyalcohol, sorbitol, sugar, and water.

21. A pharmaceutical composition comprising
a cytotoxic composition according to any one of claims 1-14 and 16-17, and
at least one pharmaceutically acceptable excipient, carrier, vehicle, aqueous carrier, nonaqueous carrier, solvent, buffer, alcohol, polyol, antioxidant, antimicrobial agent, isotonic agent, surfactant, chelating agent, stabilizer, adjuvant, preservative, wetting agent, emulsifying agent, dispersing agent, dispersion medium, coating, or adsorption delaying agent.

22. A pharmaceutical composition comprising
a cytotoxic composition according to any one of claims 1-14 and 16-17, and
at least one pharmaceutically acceptable excipient or carrier comprising: acetate, alcohol, alpha-tocopherol, aluminum monostearate, ascorbic acid, ascorbyl palmitate, benzyl alcohol, butylated hydroxyanisole, butylated hydroxytoluene, chlorobutanol, citrate, cysteine hydrochloride, dextrose, ethanol, ethylenediaminetetraacetic acid, ethyloleate, gelatin, glycerine, glycerol, lactic acid, lecithin, mannitol, methyl parabens, monostearate salt, organic ester, paraben, phosphate, phosphoric acid, polyalcohol, polyethylene glycol, polyol, propylene glycol, propylgallate, Ringer's solution, saline, sodium bisulfate, sodium bisulfite, sodium chloride, sodium metabisulfite, sodium sulfite, sorbitol, sugar, tartaric acid, and water.

23. A pharmaceutical composition comprising
a cytotoxic composition according to claim 16, and
at least one pharmaceutically acceptable excipient or carrier comprising:
  citrate, polyalcohol, sorbitol, sugar, and water.

24. A kit comprising
a cytotoxic composition according to any one of claims 1-14 and 16-17 or a pharmaceutical composition according to claim 23, and
an additional reagent and/or pharmaceutical delivery device.

* * * * *